United States Patent 9,976,180 (METHODS FOR DETECTING A GENETIC VARIATION IN SUBJECTS WITH PARKINSONISM) - sequence listing, part 23

SEQ ID NO: 353 - DNA, 967552 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctgccagctagcatcgttttcttttgaagtttgctggtctttaaaccaaaacacccccctcaacccagaaataactattttaatacgtcctttggtaacgtctttaaaacacattagtgaactggttttgctgatggtagttttaggaaaattaacttagttgtattccaagatacagctaacgaacaatcatggtaaggaactcgatattctgagattggcgaagatgagagcattaaacttaaattagctgtgttctgtgtcctgtgaagatgatttatgtgtagtaacatgacttaaatgttgtaacattttaaaggtctgagctcaaaactatcatccaatagcttaacaacgaactcatacttttttttattgatgcttatgtaacgttatctaaattgtgcccctccacccccctccagctttcataaatgctccctcttatgttttactacatgaaaacaaattgccatatttctggttaatttaactcctccattacttggaaaattttcatttcacttatttgtgctttttgcttaatgacttactctggaagaaaagcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctgtgtgtttaattgcttgtgactttcccggattcctaaaaagccaagtctttaattctggaaggcaggtggcaacacatgctttctttatgccatccaccaaggagccagctgtgagtggtttggaaggatgacttctgaggctaaagatgtataagcagtcttatgtgtgaagtccgtggtgcctttagctttactgctggactctttacaggcttactgattctggcagtgttcagtagacctcctagattcagcttgcattcctcaggcctagaaaggataggaatgttcttgtccatggggctgtttgttcatagtcctcagtttctcatttgaaattgtctccacttggacctatggttctccagctttggtatgtgttagaatcacctggggaatttgatgaagctgtagagtacctactcttcctcttccatgagccacatttgctttccatgtgattataatacacattggaattcgagaactactcacttattaccttgtgtttccccctattccagacacctgctgacttcctggaaactctctagcccagtgtttctcaaacttggttgcacattggaatcacctggagctttaaacttctgatgcctggatgtcactcctagaattggttttaataaacttgaggtttgatctgggcatcaggatgctgagacaccccctcctccctccaggtgattctcatgtttagccaagtttgagaaccactgctctaatggttttacgtgaggccacatggcttgatttccctttcatgccttcctgggcttattgtcctcccccaacaattgcagtgacttttatggaccttgggcctgtgttcacttacacctgttccaggttcatgatttgaaactcaacagagtacactagcttttcacttatgtatcgtttattcctactgaaactgttgagcccctgctttgtgctgcctgaggtgtacatcggaatcactggtgaaaatttaaaatacagttatctggactccacctcagaccagttggttctcagaagcatgcatttaaaaactcctcaagtgattcttgtatgtttgtgttactttttttattttttatttttaatcctcgtgttggttaatcccataatgtcactcaatttctctgtcatccttagcctgatttttctgtggtctgggtcacttttctcaggccaattcccagccttggacagggtgtactaattaggcatttctgccacttgtttgctagagtgttgagttcactacaaatctagcttccttttgggcccatgttgctttccattaatccagaagtactttgcttcccctcctcctaacctactccctttacaactttgtaatttgagtttcaactggaacttgagttctagactcccttacttgaatatcatcttaataaagagtcttgcttagtgagtgctcagatagttaattaaattttattaggccactgggtatttaacagacaactggtctcttggttggttactgtcttccaaatccaacaataagcagttattaccctctatgcagtctgcatagccacctgtagctgtcctttattgaacctttacgtgccaagcactaagtgctcatttattcttcacagcagctcctgagaggtagacagcatttttgttctcatcttacctatgggaaaactgaggcattcagatgttaactaactttcctgaggtcccaggaccaggagtggtgatgccagaatgaaaagtctgatccagagtctgaacataacttgagttcataacccctgggctggagcgtttcccatgtagcctctgcctttataaggagagggaaaaatgggcagcaatcagatctgtaccaaagggaaagacggtggttgatattttctaaaaacagtattgagtaatctgacctcaagttttagataaaccttatttacgattatgattgcaaaataaaaattacataatttggaaaatagagatgagggatgtatgtaaccccttccatctacacattcgtctcctctaagaaaatgactatcaccattttgatgtattcccctaccccaatttttctttcataacataacatgaattccagcttcatgatggtctgttggcagagattagaccaccccagaatggactactgggagtgcaccaactatttatttgaggaacatttggaaaattcttttatctgcactgaagtgtatgaatttgagtcctttaactaaaggaggtggagtttgtaaggtactgatcttttattagtttgccttagcacacattttatgtaaacagttaagtttaggctatactggggtttatacctaaccagaagtttcctgggccctcaaatactgagataaaacaacgtggaaggctgcaagttaagtgggtaattaagtgatatcaggtaagactgtgtagtttaattctccctaccagttgcctttatgttatttccatcctcagagcccctgtattgcttgtattggaatacataggatttggcgtctaaggtggcagaggtgtgtggcatgtagtgtctttctgcctgcctgccttacggtgtcccagagatcagagactggtaatgtcagctgactgaaactagagaatggaatggacacaaagtgaggattctgattaggtcacggcttaaatttctctaagaagtaaagaaagtggtagttatgagagtagacctccaggtccaaatgcgttgaaagttgaattaagctcaaggtggggaatgaaaatcacattgaaaggtgtagtataaagaaaaattaaggtttatttacaaaagaaagctattgatgttttgttatttgattaaatactcctggtacccaattatacatttaacccaaagtaaccgagcattttaatttgcatagtttctaaaattttatttgacttcatttctgtaaggcattatcttaaatttccccctaagtatgtacacctcttttttttaaaaaaagggcataaacgttcgtagccataatcctgagggaggacatattttgtcagttgggacagcaaatatggcacctcctgccatcctatggtagcaagtagaaagaagctataggttcttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtcagttttgtcttctctctaggtgttaggcgcgatgcaaaaagaatgaaagagattttgatagggtatgaccaagcccttctatacaatggatgtcagtgttgatttttatacacaaaccaccagatggcaacagaaaaagtgttcatataggatataatctgtggtttccacagccaagttttttttttttttccttccatgattcaccactttttagtatgcttaggtaacatgtacaatttctggctaagagcaaggcgagtttataatacccagctatgtgaaatcaaaaccaggtaatagaatagtggcagagtgtcactagaaaaagattttttttttttttttttacatgagtgtataaactgttcccaaagggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcatctagacagagctgttaagttgtgtggatagatgaattttgcaaccagaggagggtctgggcttttggtataaatatttgtggagacagtatagcatactgtttaagaggataggcttggcataaaataaaacaaagttaaccacttgctagctttgcatccttgggttggctacttaatcttcattaatcttgacttttcttatccctgaagaattgtgtaatgattctgcctgcttcctgtagttgttgtgagggctgattgatatgattgtaggtaaggtgtttttatcgcattaccaagtacatagcatgcatccagtaagtgttaggtggtgttatttattcttttgtgtagaggaatcctgccttatttatcttttcttttcctgtaatattagggagtgatgagtcacggtagtagagtggggagtatggacagttgacataactggagaggtattatactaatattagcctggctgggatacaacctggataaattgcagggcgatgggcctggggggagagtagagtgatggagatgagttagggaatggttatgataatatagaaataatatttgaactgcagtagtattgggatggaaaaaatggaatggtcagtcttgcttagagaggtaaatagatgagaacaaaaggccattggatttgttgattacatgggtaatggtgatctttttgagctcaatctcactggagttctaggagtataaagtagattgaagttcattatggaatgaatgggtagggagaaaagagtcaaccggtatgttcttgttctattgaaattctcaaggaaagagaactatggaggcatttgaaatgcatagtgacaaaaatgatcttaaaataccttgggaatattttttccaaatttgaaatctattattgaggctgggaaaaaaaattgtcatttggcagaatggtaagtaattatcacaattctctgaagtgatcatttctgtttcatatgttgcgactcgtggaggcttctagcaacattgtcaccaaagctgaatgtggaggactcccttcaccaccctgctataaacacacagaaactgtggacaaaatataacaagaacaaacaagcgtttctgaagtttaaaataccagggaatccctaggtgccagctatgaacagaaaattcagagctagggcgttaatcaggagctcaaggcctgtggtggtttctgatctgaatacacgccccaatggcttagtcctgagggtctcatggaggagtaggaggcatggccttgggtctgcatagacttggaaggtggagtaaaggttctctagcatcaaaccttgaagggcttttccatctgtgaaaagagaactagaaaaactttgcctactggtttgggaaagtgtaggaaacttgctgtcctcctggggttgtgatcattaggaataaaaaagggacatctaaactccaagattgcacctcataattggggtggattcaaatttaacatttcttatagtgcaactaaccttcaagctgagacaaattagcataaaatctggtctagaactatggaaatgaatagagccctcaggtctgaaactgacctgcagagcaaattaaaaatctaagactcttgcagaagaaacaagtcatgctatagatgagcttgcaatacaaaaattgcccagctacacaaggaaatgaatcaccgtgaaggagagttagcagatgaatagtattccaggagattgagatgataggatatatgaaagagattaattgcttaaaattatgagagatgaaaggggtaagatcataatgaaagagcacagattagaaaaataacatggagttggaaaagaacccagtaggacttctagaaatgaaaataatggtcattaagtgtttttttttaaaaaaaataacctcaatggacaggttaaagagccaggtagatataattgaagataaaaactgtattgaaaaatcaatagatttttaaaggagatctgaggaaatttcttcgaatacagtaataagggataaagaaatggaaaatgagtggttacaattcatgaactttagaatgaggaagtctcatattaccttctgtgagcttccagaaagaggaaatagagtaggagagacactattagaagatagaatggctgagaagttttcataatcaatacaagttctgcctgagctcttagtttcaagaaccgtagtaaaccccacacaggataaataaaaataaattcatacctagacatattgtagatgaagccttagaaaataagaggaaagcagtctgaggaaagttgatgtctagactggcaggcattttgttcatagcagaagatgattgaataataacatcaaaggctggaagtggaaatccactaccaacctagaattccatgtccatataaagtattatgatactcaagagtaaatgaaatggctgggtgtggtggctcatgcctgtaatcccagcactttgggaggccaaggtgggcagatcacgaggtcaagagatcgagaccatcctgaccaacatggtgaaatgccatctttactaaaaatacaaaaattagctgggcacagtggcatgcacctgcagtcccagctacttgggaggctgaagcaggacaattgcttgaaccctggaggcggagattggagtgagctgaggttgcgccattgtattccagcctggcgacggagcgagactccatctcaaaagtaagtgaaataaaggttgtagataaaaaacaaagttgatgattagtagttggaactactaaaaaatgcacttcaaaaagaaagaaattgaacccaggagtgaggtacagattgtaaagtgctaaatgataggaagcattgttgcaatgtgccccttaaatttatatgtaattgctttgcagtttgagaaaagtgtcagcagtttccactacaagtactcatactgcagattaacggattagcgagagtgtaagcagtagggacgggtttgggagatgttggtcaaaggatacaaaatttcatttagaaggaataaattcaagagatctgttgtacaacatggtgactataattaatgataacttgttttattcttgagttgctaaaagtaaattttaagtattcctaccacaaaaaagtatgtgaagtaatacatataattagctctatttagccatttcacaatatatatgtgtcaaaacatgtcgtacacaataaatatatacaaatttttgtcaaaattttaaaaatgtatgtgagcaggagttaattcatctaatgcctcagtgaataaagtgctgtgttaaaggtatagtgatcaataacagttgcttccttcagagagcttatagtttattagggcatacacaccaaaaaatacagcgccaatgtgcagatgaccctggagagccctttaagccatacaggggattcagcatctggtagataagtgttaaataggaccctagcagggatacatataggcaagccatgttggaatctggggactcagattggcacgtggaaatacaaagatgaaggattcaggtggaaagctgctgatcaacaggagtgaggaacccaacacctagatcagaacaggattcttgccaaaggaccaaacatcaagaccttcatatttagccagtacattccaagtgacctttacattctgaattagggtcttattgtcatagctgtaggaaatgtggacttggatcttggccagcagagagttagattaaatgtgcagggtgaagcactgttcagagctgagataaagcatacacaaagaggcaagtggttgagatggagcagctcagtggatgagagttagttacagatgagattgtagccatttgcatttttgtggcaacttgatatgattggttgatgctcatcaattcctgaattttgaaaattacttatatctgtatcatggaatgttatagttggaaagacagaggccatctgcatctctaactttgctgtcttctgtggaatgaaaagcatgaaatataagttgtgttatgcttttatatagatgaatacttcatagcaattaaaatattataatctagtgttttattagatgtagagatgccttaagaggttttattttaaacccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaatccaggcccttttaaatatataactcctaaatgaaagataccagacccaaacattatgaaaagaaggatatttggggagtgcatctctcatttttgatcttgcatgttgtgttgtatggaccttggaatgtaattttctgtagaaatatttgaaaatgtaatttgatacccagtccacactgcaaaagcctatttttttttttttttgtcagggtcttgctctatcacccaggctgtagtgcagtggcacaatctcagtttactgcagcttcagcctcctgggctcaagcaatcctcccgcctcagcctcctgagtagctgggattacaggtgtgggacaccatgtctggctttttttttttttgtagagacaggtctcactatgttgcccaggctggtgttaagccctgggttcaagcagtcctcctgctttggcctcccaatgagttgggattacaggcatgagccaccatgacagatatagagacacatatggagacacatagagatgtgcatgtaaaataggcccaaaagcctatccgtatgtgtctctctatctgtatatacatttctttctgtgctatttaaaatacatgcagtcactgtgtgacatattacatttcaagtgccaacttgggaatggtggaactctgcctctcaccttgaggacagcccttctttgcagcacagtcaatgactaggaggacagtaggcctgtgtttacatctgtgcaagaatggcatctgccttcatctccgcatgctcctagagaaggagccgtttcagcgagtcacttctcaggtattctaaatttggtaataaaaggacttgatgcactccaggtgcagtttctctgaccatatcaatgttcttaatttttttttgaggggaggggactgtgtcctaattagtaattaaggttattttgatagcaagtgttagaaaaatgctaattccaagactacaagcgtatttcacattctgaaatccaggtatcctaagggaccatggactggaactccactagatactactcagaagcttcgtccgcctcatctgtctctacttttacctctgtgacctagaggtcacttgaaacaagcttcctcctgctcgtcagcttcattcctctctttctgatgactgtctttctctagccatctgagcctcctgtcctatgtgacagtctcagctcatgactttccatcccctcagtttcaagagtgtgtctgagacctgattccagaatcccaaaaggcagaatgacattgactgacccaactggagttcgttaggtatccgtggcttgttaggaatctatctctagtaggaatgtctgctgccctgggggccgaatcctgcctgtgcatgacctgctagggcccatgcctccggtggatggaatgaagcaaggatgggggctgcctgcagagctgtgtcactcacttgtattcagctttcctgcctctggctctctgtcttttacctttttttgttcgtttgtgttttgagatggaatctcgctctgttgctcaggatggagtgcagtggctagatcttggcttactgcaacctccgcctctcgggttcaagtgattcttctgcctcagcctcctgaatagctgagactacaggcacatgctgccacgcctggctaatttttttatttttcatagagacagggtttcaccatgttggccaggttggtctcaaactcctgagctcaagtgatccgcttgcctcagcgtcccaaagtgctgggattacaggcgtgaggcaccacgcctggccttttatcacttttaaactaagaaaacaatgatcaccatacatgctctgcttccaaactatactttcacatccaaagtacccccagatcataaagtgccaccaaagagctgtgatatgaagaaagaccccgggtagaatcactctgaaaatgtgggaggtttttttttttttttttttttttaaagcaaattcattttacttagccagaatcctaatagcctgctgatttttgtagatgattactctgaaaacatatgcattggtgtggtctatgagtaaggctctgccttttaagtcacattctttgctgcttcattgcaatgaaaaataccaaaggtgaataccaaatcaattttttttagtattgtacttgtaaagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatagaaaaacctgtgtctggctcaaggtaatacttgaattttaataggaacctaggtttgctgtcttcccagtgtagactgtagcctgcactgtcatagaagagtgttgattgatccggttgtgaaatagatggatacccacatttaagttgcttttgaaagagtcagtttccctccacaaatatggcaacaaaattcttttataatccacaaatagaatttttcttcatctgaaagagatttctcctaaaccagcctgaaaaattgcttttctaggaagaatttcatggctgagcctcattcttgtacagattcatagcatgttattactaacttgtaaatattcacttacagaagagagtgactagaatctttgaattcttttatattggtgttgaggtttctatccaagttacgcagtttttcattcattttagaggaagattttctcaaacaaggattcttcgtggttgcaaaacctatccccagagattccagtcaacataattcaagttgaccagtggattctaagtgtgacagtacggtgtttagcaagtccaagtgaaaccagatggaggtcagagaatatgcctggcttcgtccacattatctagttatctgcctcaaccctctagtttcaaccagcttcaagtgaatgttaaaccagactgctgtaatctacacatgctttcacacttcaaaaggtgtgtgttagttgatatttggtttagtcatttcgtctcttgagaggaggggttgaagtttttatttccagtagtattttattttattttattggatgaagttgtttttatttcttttctccagaagaggtaaggaaggttcctggattattgtatttggttggtaaactctcctctttttctctttctgtgtctgcatctcctcctttttctctttccctatttcttcttcctcttccttaggtttatatgaaatagaaacaattttctagcacaatgactaagtgaattgctacattaaagactggctggccaagaaatggttaatctttgtatggcaggctttagggaccaacatcaaatacaaacatgttggaaatctttttgtcattccagctcaattgattcagaaaaattttaagagcaatagtcagtgcttggaggaaaaaagaatactattgtaaatttgagacgttctcatcttgaacatggctcttgtaaatcacaagcttgacaaccttacagagtacatacaagccgtggttgacttcagaaatatgtgttttagacacagttttacatgaaagtcatgatattgtaaatataatgatttattaataagtttaacttttgttaggatactttgcgcataactaccgcaatgcattaagaaggaagtgttaagaattttcatcccacagatctgatgatttaaagtagtgttccatttgtgcagtcaatagaaggaggtgcaacaatgaaacagaaacaaggcaaaatctatccatatgggctcatcttatgacctgttcttgctggtaattttggcgtattttgtgatgatttttttttcctctctttttgaaggctcagtagctgtactactcactctaccaggccaaagagtcagcgtgatggagagaagattaggaaatcatgttttaaaattcttctaatgcagatgaatatgtcaacatgatttttctttcatcaggagcctgtaagagaatttccaccttgttcgccttggttttggtatatgaggtggactttttacttaggtgtcctccctgttgttttgaggctatgtgccctacgccactgtggtttaccctgaggaagtttgcgtagctcgcgtgccaaccacttctcttggagaagacggagtgtcataactacagctaacatttattaaggatcttgcatgtttttcattttaatcctcacagctccttaagtattatctccattttgtagatgggacatctctggctcaggctcaaagatgttaagtagctcacctaaggtcattttgccagctaagtaaccaagctggggtttcagcccaagccaactttaccgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatcccattaataagatacaaagttatatcccaaaagtaccaaattatgtaattctttttctgattagttcattgcaacttgttcagcttcaaataaattaaagatttcttagttattgtgattcttaataattttgcaaaagtctctgtatttttttttttgaaatctttttctcattatttatggaagatagtgattgggagaaagcaaaatattaggcattaaaacagattatactggagagatctattccagtgtgatcaccaaatccacctattttgatacttgacttatgaaggggactgcctttttttttttttttttttttttttttgagacggagtcttgctttgttgcccaggctggagtgcagtgacttgatctcagctcactgcaacctctgcctcccgggttcaagcaattatcctgcctcaggctcctgagtagctgggactacaggcacagacagtcacgcccagctaattattatgattatgattatgattattattattattattttgtattttagtagagacggggtttcaccgtgttgtccaggctggtttcgaactcctgagctcaggcaatccgcccgcttcggcctcccaaagtgctgggattacaggagtgagccactgcactctgtgggggcttttaaagaggaagtgaagggtaactcatctctatcctactttacatgccccacctaagtccaactcccactgcctgtcttctaagggacatcttgtggcttgttctctgctctgctcgtattcagtctctacgtccctcatgctttctcatggatttacaatgattacttactctcaaacttatatttccagccctaacctctccagtgatcatttgttaacaagattgtgttaaaggaagcaacaaaggttcttctattggatgtagttgaaaaagcagaactgttgctctggcctaaacattaactttggagaggtttaaattctgtttagaagttataaatgagcttaatatcatgtgatttgcatgataagttattttaaagagtttaaatccatgattgttcaaaataggttgttttattttcaatataatatggttcttaattgtaacattaatgaacactgaagacatttttaagattcatttatgtaaagtgatttgatgaagtaagctgacatttgatggacttagtggaagtttagacccaatttgcatttcagtggtattttatggctgactttagaaaactttttagataggatttctcggtaaattaaaggatttagagggatgattacgaaataattgattaaaaagtgtgcaatattggttttcattgaacttaagcttgtatgggttcaatttaaaacctaattcaatacattttagattttatatttccctgaacctcttctgctgtattaattttgtcatgcttgtcattctaatctaatgatgatttaatgtttgcaaacctgaataaatctgtatgcaaggagttttgctgtgtttttaatcaatgaagattgaaatttggcaactgaggtgataaaaaatgaaaaattttaaatagaaaatgaaaataatgattatactttagaaagtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggggctgtcacttagttggtgtgggacctctcatctctattgccaacccaagtttttgattctttctttcctcagtaaactcttaatctttctgtccttggaatcttctcctttcacttcaaacaactcatctgtctttatcctgaaaagtttatactttactaagttccatcattggcagcaaccctgttttcttcccctttgtattaatattttttttttttttttttttgagatggagtttcactcttgttgcccaggctggagtgcagtggtgcgatcttggctcactgcaacctctgcctcctgggttgaagtgattctcctgcctcagcctcccgagtagttgggattactgttgcctgctaccacgcccagctcacttttgtatttttagtagagatggggttttaccacgttggccaggctggtctcaaactcctgacctctcgtgatcagcctgcctcagcctcccaaagtgctgggattacaggtgtgaatcaccatgcccggcccccctttctattaattatccaacatctcaaatgtgcagttcatcacatttttggggtggtggttagacacaatatagttaacctatttagataaataaactcttttatttcccctgagtgaacatttcatctaaaacgtgtgtcgctttcttgcttaaaaaccaataaagctaatgtttctcaagtcatcatatatgagtagcatgcaagctccggatgcagctgttcctctagagactactgttgcgctccttacaagcctctagagcactagtgaagagtaatgttagattgtttcgggtttggtcaacctttcctaagactcagtggacagcaatcagttaatgtgccaagaagcataagctaaatccagattgcaacatactactcattctgaatctgtaagggaatgcctctgtgagtcactgttgtgggaatgtcctgggatggcatagttaatactttctaatgggatttaaaaagtcagtacatttctctttttgaatttgtttcttaatgatctgatgcacttttggataagatacagcttgctttatagaacagaaaaaacattgtcatttatacatgatttagctttatgatcatgatttaaagccaccagctttgtgggaggaagatagtgagaatggccatgacagctttaactacacccttgaagacctccttgcttactagagggcactgtgctgtcctcagatgccctgaggcaggtcagattgggataataattacattaactcccaaactaccctgtgctggactttttttttaagttatagctctatggagatataattgaaatatagtaaatgggaaatatttaagatatataatttgatatgctttgacatattcacagtagtcccctctcacctgcatattcatttttttgtagtttcagtcacctgtggtccgaaaacattaaatggaaatccggaagtaaataattcatcagttttaaattgtgcaccgtcctgagtagtgtgatggaatctcgcaccatcccttgtgccctgtaaaatgaaggtgtattccagagaacaaaggaaggatggagcttttatagagcatctttctgcccaggtttgcattcaggtatattttttcaaatgaaggagtccaccttgcttagttcaggttgctcagtgcaagtgatttctgattggttggtgcaggctatacagtctgttggttcaggtggcctgaacaggaatggtaagctgcgaaggttcggagttaaacagatgtgtaggttttctggaaacttggggtacatgtgtgaccattagactcagttagcccctcaggattcatcttgagggatttgctctttgaggttcacagtgatcagatcaactgttgcagtatctcagtgcttgtgttcaagtaacccttattttaattaataatgaccacaaagtataggagtagtgttgttggcaattaggatgtgccagagagaagatagaaagtgcttcctttaaatgaaaaggtgaacgttcttgacttaagaaggaaagagaaaaatatgctgaggttgctaagattaagaacaaatctatccatgaaattgtgaaacaggacaagtaaatttatgctggtcttgctgttgcacctcaaactgcaaaagttatggccacaatgtgtattaagtgcttagttaaggtggaaaggtaaatttgtgagtggaagatacgaaccaaaaagatgttccaattgacagcaatgtgttgtgccagaatcattcagcctatatgacgacttgagcaagggatcccttgaaatgagttacaccaagtgagggatagttacacagattcaagaatacagataatcagtagtagcctaatgctgcgtcacaatgcatacgtctttcaccctacttcatctcattacataggcattgtaccatgtcacatcattacaagaagaaaggtgagtatagtacagtgaaatattttgagacagcccatgttcacataactattattacagtatgttataattctattttattactagttattgttaatattttattttatgatttataaattaaactgtatcataggtaaatatgaataggaaaaaacagtatatatagggttcagtactatctggtttcaggcattgactggggcctttgaatgtatctcttgcagataaggaggactcttgtacatcatgacatgtgtggatccaaaatctcaaaaaaacaaaaaacaaacaaaaaaaaaccaaaatctctttttgtgtgtgtacatgaattgttccagcaccatttgttgaaaaggcttcccttccttcactgaattgcctattcactttcttggaaatcacttgtccatgtatgtgtggatctatttttggactctgttttgttccgttgatacatttgtgtctctttgcaaccactctattttgattgctgtcacttcatcataattcctgaagtcaggtatcattagcctcccaactttgttttcctttttagaaacagcttgttagtttctaccaaaagatatcctgagattttgactgggattgcattggatcttgtaaatcaatttgggtagaatagacatcttaacaacatcgagtcatttctgagtctctcacatgtaaaaccattatctgcgtttaaaatgtaaaccactcagtgtcaccgatcataaaccaaaagtgatacttagggtaccttgaaattacattaagcagaacactgggaattggtctttttgcttgatttgcctgagtgattctccacaaaatccccacttaatatgataggtatgaatacgggatgccttatccagagcagctctccacaagcatcctcacgccacagatgccagttgaccgttacgtgtactcacctagcctgctggtacctgccagatggtgggcattttgggtgagattatgatagatttaagccagaggttcaggaatatccacattctccaaaaaagaagattaagccattattattgggagcagcctaattctagttatgaaggaaagagatcagggtgccatatgtacttagatagccatgtcttttatagcacatagcctttcatgttaaagctccgcatttttctaaaggagtattgattatagtaaggaagccaaggttcaactcgtgtatgtgtcaggtagctggatcattcattaccaccataggtgacacccatgttgatcagttacataaagaccacaaatggaatggtaactgggtcattgcaaattaaccctttctgaaagacagttcaggacatatttatccttgagagtgagcctacactatcctcctaagacctctcttttaagtggagaatatacattttggaaacaaggttgtattgtggttgagggcatgaagtcaacctgcctgagttcaaatcaccactctgcccttttctaacttttcaaatttagggattcacttagtttctctaagcctattttctttgagaatatggaaaattattatagtaacatggggaaattaaaagtgagtaattgtacaagtttagtgcacttgatatgttttgtttttagcatattttctccatttttcctttttccttttgtgtgttcttgttgccagtgactacctgtgaaatgtaaactgttgagtgaactgcttttgctttactttctgtgaattacttgttctactcactgtgttctgtctcttccattccctccgaacacttttgatcttttcgttttgccccagtcttctttcatttaaaaactaatttctcccaagaagcctgctctataaaggatgtgtagattagatgaggtgtgggaagcatgtttacttataaagcaacacaataccctatccatatccagcctgtaaaaataaaaatctaagtgctttttttttttttccctcccaagtaaagagaaaagtttcagggttatatccttaacatgtaattaagagagttcaagatattttatgttctatatagcaatgcagagaatatttaataagcattaacaaaaaaacttaaccttgtggtagatagcattgtactaattaacagtttattttatttagctacaagaactatgtcagcatgagagctaacactacttatgtttgacaattttagaataggaataaggtaaaaatactcaacagagataatggtagcttgcaaaccgtttatgtcaaatatattaaaatttggaatagttgaagactagaatccaaattcaagagtaattaaccaaaatagttgacagatgtcagccatgctaataaaatttgtataccctgaatattttccagcttgtaattaactgcacagatgatgtgatctgattttgtcactaactgcttattaatgaaggagatgatgactagttacaaaatccatagtgctagctgaattccaagtttaaatgtttctcatacagccggcattaattggagccacactagcctccatgctggtttgatttgtgcttactttcttcatttgtaattgcgaaggggaaactgaatttgttaaattcagctctgagtgaccttgaagatagtaaatctgtttttatttggtggtcagcagcgtaatggcttttatttttagattctttcttataaatgtattgtcatcaggctagtgatatcaccattggaagttgtataataaagtgcaaactgattatttcaagttcagctaaaccacagcagaacatgatgtcaatatgactgaagatgtgaacacagagtgctattaacaaatggtttaataacaaaagagcattatttatttctatcatatacatagcacggaagcctgagaagaagcaaaaggattcaagagaggcggttgtgcagccttcctgcctgcgccagctctctcccagactcctatactgctcttccttctttaccttacgttgctgtttccctttttacttctttccctggaaagggcgggtttaattctgtccttatttataagacagagatgtttgctacctcctgagcccaagtctgccagctgttggccttcttctttgggtggtctccctggcagtgtggtcttacagtatttatgtctgcctgctagctggttttgcctgttggacatctccacttggatgtctaccagacatccccaacttccatgttcttagtgtcactttaattttcctttccccaaattattttctctaccgtagtctcttctttcttatttttgtatttctgtgtttaggagtgcttaatgaatatttattgagtcaatgggtgatttcatgatacaattatagtagcaggtagtactaaaaagaggaactattttctccttatttaagaactttttataagagaactctagtttttcaaaattctgtttaaaatgggccacccagaactggacacactcttctgttgttcgttagtgttcgccttagatggccccacctctctgtcccctctctctagctatgtatatttcttttcaacagtcagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcacaaacaaaaatgtaaggtctatgtgatgtagagtaataagataagaaactatttcctacttacaaactactttgaaaaattttgaaagatgagtttaaaatgtttaaaacattggtaataccagcagagtcagtaggcatatttgtaggatacttagtataaattttggtgtatttattttcttaaaataaatcacagtgaaatcatattattgtatcttataaaatgccttactctgttgaaaaggcagatttatattaaaaacctactagctgcatttatattaaaattgttcaccttattaacaggtcaaacaatatattcttttaagaattcacattttaacacttgggtttcagctgataaaacttatatgcatttgggtataatcttagatacctacaaaacagcaccaagacaaaaatgggctcaataataatgagagagcaagtattttaaagaaaacagaatttactgacttttaccatggttaggttaagttaggttaaactgtggaaggaaattgtgctgtctctcccctaaaaagtttaagagcaaattatcatcttgaatggtttagttattcacatgactgaagttaggaaccattccttttaactttttattttgaaataattatagatgtgtaaggacttgcaaagatagtacagagagctctttgtgctcctcacctggttgctcctaatggatattgcttatataatttagtacacatcaaaatcagaaaactgacattggtacaatgtatatgtgtggttctatgtcattttatgaaccttccttgaactcttcttaccccacactgtttataactgtcttacatatttcttctacacacattaagaatcacattagacaatattatttttgtttcagccatcaaacataatttagaaaactcaagagaagacagtctattgtgtttacccatatttttgcttatgttttttcttccttcctttccttcctgatgttctaatattctcttatcacttttgtttttttcaactttctttacatattcttgagggtcggtctactggagacaaattctctttattatttcaactgagaatgtcttaatttttatcttcatttgccaaggataattttgctggatatagaatttgcagttgacagctcttttctttcagcccttgaaaaatgttctattgctcccttctggtcctctttagtttctaatgagaaattctgtcatttgagttggtttccctgttaggtaagatctcatttctttctcaagacatgctaataatcataagattggttattgtaattcaagcagctactatgtgcttggcatggtgtatgctgtctgtaaccttgaaaccctctattatctctattttgtggataaagaatctgaaactcatgcaagtacattaacttagctaaggtcacacaatttagaaatgtttgagttaaggtatgaaccaaggcttgtgtgcatctaaaatttttgcactttatcatacaattgcggaaagttggagacaatcttatagttgataagttttctaccagcatcttacagcaaaaattacaatttttctgccagtcctttctttgactttgagtagaatcttaaaaagacactgtgtaagagccacgaaacttccttgcagaagctgtatcatgctaaatgttttggatcaattcaactcaatttaataagtctctgcttttaatttcattttctcaccgtgcattataaaatagcatttgtagaataagttaataataattttaagcaatacctattttcaaacaagacaaaattattattctatttgaattcaatccctaacaaataactagtatcaaatcagtggtactgcaaagaatagttaatatccagggtattgttttagctgcaagtgtttgtggattactgaacagtcaagtgggtttgctttgagattattgctttcccatgtgtttattctcttcacagtctttttcagttgttgcctggttcatctttttagacatcatgtaattggtagaacaacagtcaagaaaaaggttgaaaaaaaatacagatgagttctctggagatacgatgaagcaatctgagtgaatcatgatgtgcagtgggctttaggtttctatttttgtgcaagggaccgattatagagctctgaacttgaaatcttattaaaatctctgaagatgcagtagaatacatctcatttaagaagtgttctctaagagatttataattcagtattgtttatatatgtcttagtatattagatattattcattaacctatattagaggagacaatattttacttaatattttcttaagttacaaaagtaaaataacttaatagtaacaattggaatgattaacatattgtgaagcgaaacttatctttaccctagctgattgtgtaccatctcttctcaaataatgtgatattaatctccaactgatgttaacattgtagggtgtatctcttcatactcttccccatgctcaaacaagtacacacacacactcacttactcttcacatgtgttggacttcaataataataaatgtatgcttcataaattggaccattcgctaagttgccccccaccccattcttctaggacagtatgtatagaacagaatcacttaaaattaactggagtgtattctatagtatgaatgtactaattaattcagttattgcatattgatgtacatttgggtggcttcctgtgaggtattgttttttgtttctgttataaacaatgagacggtaaatatcttagcttatatatcttttttttttttttttttttttgagatagagtttcactctcgttgcccaggctggagtgcaatggcatgatctcggctcaccgcaacctctgcctcccgggttcaagtgattctcctgcctcagcctctcgagtagctgggattataagcatgcgccaccatgcctggctaatttcgtatttttagtagagacagggtttctccatgttagtcaggctggtctcgaattcccgagctcaggtgatccacccacctcagcctcccacagtgctgggattgcaggtgtgagccactgcacccggcctatatatctttattcttacacaacaatgctttgatttccagagggtaggtttctgataatgggactgacagttcaagggatatgtatacttaacattgtatagatattagtagatttctttcctaaatgtttactgcagtcttgtataaggttcattttatcacatctttaacagcactaggtgttatcactctttaagcaaatgtgatcggtgaaaactgctatctcgttgctttaagttgcatttgctgaatattggtgaagttgaacggcttatgtttattggccatttcagttttgtcttgtgtgaatttctgctcatattatctggccatttttctattgagttgccttttacttaccagtttctgggagtagtttttatattagggatattaactgtttggttatttattttggaagttttcccagtctatgtatttttgaagtggtttagggtatttttttttgctctagaataaattaaaatatatgtaatcacattgatctatctttgtttaggttttccatcttagttctacaaatatttgcctaaattctcttatgaatgttactgtcttattttttatataaatatcttttaattcatctggattttacttctatatatggtgagatatgtgagtcaagctttgcatttttgtagatatctagccacttattatgctaatgccatttagtaaataaaccaccctttctttctgaatttaaatgccatcagtactttaaaaaaatatttaaatggttacatttttccccagcttaacccattttcagtaaggtaatgactttttaaaagcaggatttagtaagttgaaaaggttatttctctttgctcaaatgtcaaatgctacctgttactctttattgtttctggctaaaattgcgagcacaggaaggattattcctgcgaacaaattcactaatcagcttgcaacctaacaattttaagaccctggggaaaaaagggaaagtttgggatatttactcatttcttctgtaaaagcaataacatgtaaacatagtgaagaaaggcatttatggaatctaagaaggaaagctctttgcttttcacatacagagaaattaggattcattgagtcctttctttacaacataagctctgtaggaatggttctccaagtaaagctgtgtgtcacgttttggggctaggggtgcctcaaagctgcacctacagagagatctgaaggcaaattgccgatttcacacttttattttgggctcatcctttatgccctgcacagagcgatcagatccatacacatcttactttcattcattgtggaaataatgtcctcaggcttggtggtacaaaatcgtgctttctacagtcttctgctaggaaatgtttattggatttagctgccattatacaaatgatgaaggagaggcaaagtaactccagtatctctagccaggagtggcttgaagaattgtatcagttacagatttgagaagatttgactatatgttgaattaggttagatcatctttataattagaagtaggcttttggagtacaaagaattcttctgtaaacaccttgaatatttaacaggaaggccataaggaaatataatgtgctacattcctaggatagaataacatgcagctattaaatagcacattttgtgaatatttaatagtagcatttaaacccaaaagacactgagcggcagagacctgtgtaactagtttgttcgttcatttcttcattcagccaatatttactgaacatcagctgtgctttcagcattttgtgaggctctggggaataaagatgaagggtgtagtctttgccctcctatagcttaggagctagtggacactcaggttacatcattgcagaactgtttattaacaattagccacgtgtccaggatgccatgaaaacgtagaggggaacacacaaatcagactggctgttggggggtcgacgagacttcatggaagtggtcacatcggagctgcgctccagaggaagaaaggaattaaccaggcataaaggttgagggtggttggagggagaggagctttcaactaggggtgaatagtaaatatagacactgaagaaaaatggaaatgtgtgtggtaaagtccgttattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgtgagcaatgtcctaaatctagggatgggggagagggtgaaaatataggagaaaggggcaattgttgtgaagttccaagagacaagcccggagttccaggaaaaatagggaccgctttcccactgagtctggagagaggaaggaacgttttaggatttaaggcacaggcaagtttgaggtagggcagagtaggccagggaagaatgcgaatagctgcgtttttgtttgtgaattaaagggtacattctgaggaaatggagggaagagagagggtcaggggacttggacacggggaagggagctgccttgcactgaggcctctgcagatgatcacactgcatcaatgtgatcaaaatgacgtcagtgttatcagcagtagaatcagaaacaagtcgatttcatctaatttccattatctttcactatgtgagatatttttatcctgaggatttacatgtaacataggactgagtgatttactgaaatttaagctacagccaatatttgattaacaatacaggtatgaaattaaacagtactgtcggccaccaggggttctactctgcgtgatcactttccattttgctctccttcaaaacgtccacattttttctctcagtcataaacatttaaaaaccaactgtactgggccaatcaaactagtgtagtaagtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcattatgctgcccctgttaaaatcagttaccctattccacctgattcatccttgagaaaactactcatggccattgtgggttttaatgccactgccatccccgtcttgccattgcctcctcagctctgtcctgctaccacgatagagtggaccctgtgtcacagcaccattggtacccatcctgccactggtgtctagaactttgagcagtttaaccccccccggttttccaactctttccctcaccaacttgtgaagcctctgaactggtatctgagcagagccagtgccttgcactgtgggagtttcctgtcctaatgcttaaacaatggctctagaacttggctgggcatgaggaacatcactggcttgtaagggatgcagagccctggtcccctgaataagttgccctggtgggccaaataatgttattcctcacatttggtatccacatcaaatccctggaacctgtgaatgtgaccatttggacaaagggtcttcgcagatgtaattaaattcaggatcttgagatgaagagattatcctggattatctggtggaccctaaatgccagtacaaatatccatatgagagagagacacagagggaggggaagaaaggagaggaggcactgtgactgcaggcagagattgcagtggcgaccacacaggaaggaatgccgacagctgcctactgtaagaggcaaggagcagatttccccttagagcctccagagggagagcagcctggaacttctgggctcaaaccatcctcttgccacagtctctccactcactggcactacaggtgcaccaccatgtctggctaattttttttttacttttcatagaaacagggtcttgctatattgcccaggctggtctcaagcgatcctcctggactcaaatgatctcctggactcaagtgatcctcctgccttggcagtattttttttaatggcactgagagacagtattatttcctcccggcacatttggattgactgttaagtaatcacattcatttcctgattttgatacaatgtacgactggttttgtaggagaaaaagaattgggaagttttaggaattagaagttatgtagatttttaaacattgagaactttgtcattttcattaaaaggctaacttttttgttataacttatttcctattcacagtacatcaccagctgcttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattctagatacttgttctttgctggatatgtgggttgcagatattttctctcagtctgtagcttgtctcttcatcatcttacgagggttttcacaaagcaaaattttaaattttgatagatctaatcaattttttctatatggatttgcttttagagtcaattctaagaactctttacctaccattagttcctgaagattttctttcctttttttttttttctaaaagttctatagttttaagcattacatataagtgactcatttcaagttcattttctataaatgtgagacttgggtggagattcatttttctttttaattgttcaatggatgcctattatgccagcactgtatgttgaaaagaccattcttgccctgaattgctttttcatccgtgtaaaaaattagctgggcatcttactgtgtgtctttctggcttctctactctgttccattgatctgtgtgactcttcctccaccgataccacacagttttgattatggagctatatggtaggccttagtattggatagagtgattcttctcactttattctctgtcaagattgttttagctattctaggttctttgccttttcatataaatttttaaatagtcttatctgtgtctgtaaaaaaactttgctgagattttgataggaattgtgttaagccaatagatcaatttggcgaggagttgacattctataaggtgacattctatgcatataagttgacattctatgcttagtcacaaattctttcagttttccttgtcttagaatgttcttatttgttgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgcagtcctggctgcctgggaactttaatgggggaagggagtctggaaagaagtgcttctgaccactgttgtcagtgcggttctctgttgtccgcttttctggtgccactgtgcttacttgggtgtcgttactgggattctgtttggtccgggcaaggagtgagcctgccttagctgctgcctttggttgtttgtaggtcaggaaacacggggcctggtttgctttcttcccttaggtgaggttcataagatgccctgccattacgttgtcccttcagtcttggccttcctaaccagttagtttgcctctttccacctttcttcttgcaggaagaaaatttaacttttttttctgattcttgtgcctttcccgagccaatccccacagacactatacacaatgtcttcttatctccctttaccttcccactgtcacaacttgtggttcaatcataatgtggtgtgtacatccttatgactattaattattggtcatagctgacccatacagcatacgatgaggatagctcctctctttccaggtttctgttttgcctggttggattctatgtatttatgattagctcatctctaaactgtatgaatttcagcttaatatggccaaacttgttgactggcttattatttccttttccttttcttcctggagatcttcctctaagagctacacatcagtatgagctgattgttctctgggtcttccagacagctctcatcttggcacctcacaccaccaccttctccctgtctcctttgttgttaccctgattccttggactccatgtctctctctctttctggttttacttgtttattggagcacaccttctgggagtttcctgagaatgcatgtgtaagaagtaaatgtttagacacttttgatctttggaaatgtctatattttactctcacacttgtctaggtaaaaagttcttggttgaaaaccattttccttgagaattttatattgccctttgccttatagcctccagtgattctcttgacaatggaagtgacacttggattcttttttgtgtgtgtgtgtttttccctgttggaatactcttacttgtctttttctttgatggtttgaaattttgcattgatattcgttgatgtggcatggtggccttgatctgggtcttggtgggttatttaatctggaaactaatgtttttcttttgtgggaagatatattattttcccagaaagaagtaataaaattatttctttcccctgttgtctctcttttctctttctgaaattcatttaggatataagctctaaaagtagagggatttttgtctatcctaagtgcctagagcactgtttccatagagtaggtccatataatacatgtattgcacagatgaataaatgaactccttctatgtggctgttaagtctcctggatttatcttcaaatttgtttccctcttttattgctcagttctttttcaggccatctacccccttttttcttcagaatttttttttttgtacttttttgtaccttttctaaggtaacagttgtggcaagaaacagaaccatctacaagtatacaacctacctggaatggatttttacaattccagagtaggaggtagatagaggtcatgatttattgttttctatataaatgtctgtttgatgcagcatcattataattaacataatcatcctttctccagtgcagcgcagtgtcacctttgtcctaaattgagtgactttgtaggactctttctacttgctccaggaaatacagattacgtttcattggtctgttttgtctacctatgcaccattatcaccgtatcttaattaccgtagttttacaaatagtctttatgtttggtaatgaaagtgctctaaattcattgttcaggattgtcttgatcattatttaatgggggaaagagttttaagtttccatgtaaagtttccatgtaaacttgtagaatcaattgtcaaatgacatacacgtaaacacagaccaaaaaactctgctcagatttcgaatgagattgcattaaatctatagattgacctgggacaattgacatcattatagtattgtatcttctaacctatgatttttgtgtattctttttgttgtaactcttgcattttatctgaaattgcatgagaagttttgtctattctttgaagtaccttgttcatttcataggaatttggtactgtatttgtagtacctttttatactcctctttatgtaaggtatgctttcagttgtcatactttttgtatggctcatcacttttaaatgttgctggtttcaaaagacttgaaatgcacaaatcgtttgctgtttatgtattagtttttaacattatctgatgttgacaggcagtcgatatagtgctggatgtagccactccccagtgccatgaagaacccagtttctgcctgcctttctgcttctccttccttaatgtgttaatttttgttctgtgcttttgccttatagttgaagcatcactttcctgtttcaagaaggaagtggggaggaggacaaagggacaaaggagatgtctgtagaatgtattggctctcttttttaaaatcagggaagaaaatgcttttctaagtccccaccccataaattgcttcgtcgcatattgttgggaagaccttggtcacatgaacctcctggtcgatcatgaatcaagggtagtgagatggctccacttggtttagaccagttgtgatccatgtccttggcctggggtaggggccttcccttcctctccagtactgtttgaactgattgggattccttgaatagaaaaggagagagaaataatgtgtaggtaagagaaggtatctctcgtgtttattgaggcttttcaatatgtaatttgcttttaattttaagaaacttgcctgcctcttggatagcaaagaaagtgatttttatttgtattggtcttgcttttgccaaacattttaaaattaagtgatttggggataagtatttattttgaagtctattttattgtttattaagatatatttcaaagtggtataataaatgacattattattttcataaactattgcttcctgaagtgtttcaagccaaataaacatttatctttttgatgggaaaatgctttctaaatttccctcagccaagttatagaatggagccaactgcagtacatgtgggtcacaacctgcttgccatagttgtattctgggatgattgattaatttatgcctttcataaggatgctctgagaaagaaatgagtgagaagatttaattactgaattattaacttttaggagctccactttggaatgtgagtcaatatctattacagactgtacgtgtttatgctattgaaaatatgaattaagaattgtctttggttatttgacaactcaaaagattttataactttttgtgcagcttaaaaaggaatttagaaatgtacttttagaagggaaggaattcggataatttatatgtcagtgtgtcataataatttatttacaccaaaatctcattcacagattccagatttaatgacctgaatcttgccatttcttttctttaggcctacccttattttataggttctataaaataatcggaaaggaattagaaatagttttgtgtgtggtgtcaagtggctttgtttaatcattgggaatgaatcagttaaaaacttattttggggctaaaaacagccagcccaattgttataaattggagaatgaatgaatatgaaaatctacttacagaaaccattttaggttattcatatttcctgcttgctctgtttcttgtcatttggtattttaaaaataagtcttagactagattcttgactaaatagcaacctttttatctttgacagagacacgtttcttacattataaaaacatgaacattcaagaataaatcacagccaacttgaggaccatacatatctgacttggaaatttgctaatatatacagatttaacgggattttacacattttcgtgtttttgagggcttgtaaggtttcagtttgattctcatatatgatggttgatgtgttgtacaaaccaattaggagagcaatctagcaatcccttgttgagttagaagtgtgcagaccctaggacccagcatttaccttaggcggtcttactgttgttgcatcttggctttgtctagtttctcttgattcctgtccatttttggaaccttgttttctagtcactgtgacaattctgtgagcgacatggtctgtttcccataaattctttgtctgtttgatatagctgaagttgtattacttcaaaccgtaactctgagtggtataacaaagatatcaaattttagataacacccacatcttcctgagcatcgtgtgattttagtagctagaatttctttgtacagaagtcattgtggagggaaatgatgtgaagaaaagaaagaaaatcctgagaacagagcaacagttgctgtggagtggcgtgagggccgaattcaagtataaaaatctggattagaatcctccggtcacttagtagttgtgtgactttggtcattgttgaactgttgtgaggtttccttttcagatcaaaactttcccttttccttctctcattcccatcttttcaacagatgacatcaccttatatgttacagagaaacagaagccattagatggaaaaaacctcaatatccaacttacagaaatgactgacctgcatttatcttcagcatttcctccttttattaaatatctgaggtcagtatctccacttgggttttgagttccatctttttctgtcttcctagggaacatgtactatcaatttatcttttccctttcttgaatacccaacttgttgctcttaaccagatcagtttcatcggcatttaagcatgttcaagactcttctgtattaaaaaagaaccacgacctcccctaacccttccctaatctaactactgcaccctacctcttctctttgcatttacagcaaagctcccggaaagagttgtctgctcgctgcctcagcccacacctttttcatgtggtttccgcttctgtcattctatcagaattgctctgcagaggctgatcagtgacttcagtgaaaccaggcctaaaggatgctcttcagttcacatctcactcctcagcagcattcttcaccgcttgccgctctatcgttttgaaatacctgtaacaagcatgctgccttggtttccctcctaaatgacctctgctccctctcctctcaatatctttctctcttcccccctgccccgccgaggttgagtatcattataatatcattgtctacctattattgaatgttagcatttcccaaagctagacctagttctgttccattctcaacctacaatcttttcctaagctatttcattcatgtacatagtttgaattgtccttttatgtaatattatagatgattcaaaaatttatctgagctcccatcacgtctatctacctgttaacttgatatttctacttatatctttctaagccatctcaaactcaactcgaactagaccaaacttacctatctacctagtccagctgtaccataaactttgatgccttattcttcttgatgcctcatccacattaactccacttatcaccatattttcacctcaaacacctctgtgatctctcccctcctctctctattgccgccatcctaatgcaagctgtcatcatctctttcttggccaactgtagtagatgtagtctcatccattgtggttctttctagtctgtctgggactcatgacatcgtgcttttgggaaacagaagtgatatcatgttacccccaccaggttatccttgcttgccttctcattgctgtaaggataaagaccacagaccctcacatggattttacctccctgggctaccccatttggcagctcccccgtgtgttctcccttcctttcctctgagaggtgaattgtgccttgttccctcctgctatggggctttgcacttgtttcttgcccttccttcatcaacttgttatctaactctatcctgtgctttagatcttaacacaagtgtcatttccctgactccatggagatggggtcgagatttgtaggctttgcttattcttcatagtcctttaggtttacatttaattttgtgaggatttgattaatatctcagtaaccatgatagcaagaatatctttttgtttttgtttttgttttttcaccattttaactttggtgctgaaaaatacttgtcatatagttaggactcacatattcatgaatgaatgaatgaatgaatgaatgaatgaacatagattgagttttgagccctgcacttaacacgttctttttgtgtgaccttggacaagcttttatagaggtcagttttgctaaaagccttgcttcctcacctgttaaatagggataataattatatacaataatataattgaatgaaaagtgcataatttagtgccagtaaatgggatcatttagccatgggatcatggctttcactactggagtatttacaacttctgttttgctaaagtaggtgagttttctgtgcctatttaaactactttatatccctcaggaaaaaacgatggagccagggcttaggccttgtgaggagcctcattcatttccccctctctgctggtctcactccttgaatgctggtctctccatacatttctctgccttagtgtctgatggcttttaacatgttccctccaggacaggccataggaggagggtctaatgcaatggtgactttggaacctgaattggcttcttggacacattccaggcataagggccccaaagttcttttgttctgccttaggcatgtgtaacctcagggctttttctcccagctctggagcttcattacccagaggaccaggcagatgtcaaatgtttctcttacagttcatttatatttctctgatagctttaatctaaaaataatcaaaatcgttgtatatttttactgtgacttaaccaattgtaaaaattattctaaaaatacgcagttatttctgagaacaattacactgacgcatcgttccctgagtgaaacctatacatacatgttccaagtatatgaagcagttttttggggacagagtaacttttttttcccctctgttgaaataaggtattgggccaggcatggtggctcacgcctataatcctaacactttcggaggccaaggcgggaacattgcttgaggccgggagttctaggccagcctgagtaacatagcaagaccccatctttacaaaaatttaaaaattggcccagtgtagtggcatgcctgtagccccagctacacaggagactgaggtgggaggatcatttgagccgaagggctcaaggctacagtgaactacgatttcgccactgcactccagcctgggtgatagagtgagaccctgtctctaaaaatacaaaggtattaaagttaacacttgaaatgcctttcattctgtcagtggctctttttttgtttgtttttgagaaaagctgttttttcaagtcaacatttaaaacaaggataataaatgaagcatgaagcaaatatgtataatacattattcccgttcattgtgtatgtatgtatatatatatatatatacacacacacacatataaagtactttggcagaaatatatttcaattttgacttatttttcagttcagtttaacaggacacactaatgtcgggacagtctttaaaaatttggacaaatttttaaagagtaagttgtgacaatgatattacatgttaaatttgtccttgggaaacatagacatttatgtgattttttttccctttagtatttgacatcaaactatagcttccactgagtagttttaaaataatgtacttcgtgctgctaaggctaacattgttgctaaccagaggaaccacagaggaagacttttgaaagagagggcacaaactcttacagatgtcaagagtcagaatttacatgtggtggggctaatccgtaagtgagattaccgttagggagctccttgacgcaaattggcattgtgcctgcacttccgtgtgacaagtgggattctcagggtgagccctagagtgtgctttttgacttgtagcatctctggattctgggctcaagcagaggccctcctgcccagttggccaactgcgacaatgaatggtatcgtctagaggtcatcataattctccccagcatttccataacacatacaaattaaactatgagtaaaaaaatacttaaaccaaaaataaaaatgagaagaaataggcatatgaaacataatgagtaacgtcagcataatttgagattttggcaatggaagactgaagttgagaagtgtttccactagggatactctcttgtgcctcacattagtgtgtcctgttatttaatacccacagaagcttccttttcttccttgaatggctttgcactgctctcattgctaggttcatatactgttgggtgatgggtgggatcaagtcccctgtgtgctgtgaacacacgcatcctgattcaccactttactgagggtgggaaatgacagaggttgggcctgtgttctcttgtcacctccgtatatgatcattcaggcgcgtgtctgggaaggtgtgaaggagtgtcctgtcagccagttgagaccactgtgttggtgttctctgaatggctttgcagcctatgatggagtactttagggagtcaccttttgggttggccatcagtctaacactccaagcagccatagggacgtgcagaggataaattcatataaactacacctaaggcgttcacacatggtccaagttgtctgtgaataaaaagtgttgctgtaattttccatcactctttttgtttgtttgtttttctggagtgataaagatggacatggaaccctttgaatggtgcttcaggaggggctggtttttctcttctcagatgggcaactcagctaggggaggtgaggttttgttacaggatatgccttgactactaccatgtggagcaggactgctggacatgttgccagccatgaccgagcacctgaaaaccctgtgggaaactacctgcctttcatcgagttattggaatagggagagccttaggagtcctaaggcagattttcagctttatatgctagttctgggagccgtgttctgcaggctctgccaaaagactttgacctcacaagtgagatgttccatcctgaagtcctggatgctgcttctcaaaacattaataggaagcgtgacatcaagccatgctggctctctgaagttggagaaatgctgcatgctcacttggctaacaaggtgaacattactctgtcaccacatttttatctagtatgcgtcctaatctcaaggatccagctaagttgtgtgttgtcagttggagacattagcttgggcagtaagctcagccttgcactgcttctggcaggtttactcatcttcatccactcttatctcgatatgaggatatctgttttttgagcatgttccatatccatgtttcatgtgaaattgcttgtcattcttgcttatcacttaaaataataactggctcccttcttttgtagcatttgctaatagtggcagaactatttatacgattatgataatctgtcaagaggattatgcaaagtatctccccccaccccttctctaaagcagagttaaattgaacactgtaaaggacattttcataaccaaggatttttaccaattatttactgtggatttaaattgatactgaatgactggaggcattgatttttaaagctggaaatatttacaaaccatccaattctttttccttagtattttgtctctagttacttcgaaatctctctcctctctctctctacacacacacacacacacacacacacacacacacacacacacacacacacagagatgtaaaacatacacatagaaagactttaaggaaagacatcaaaatggtaaaagtcattatacctggttggttgaattgaagttattttatacttctttatacttgctttcttcatggggaaagtatttttatgatcaataaaaatatttttctgtaatatgtatgtactactttacaatattaaagcactttcacatttttccaaaaattaaaagcacagtgaaatttgcacattgagaaacatttggagccaattaaatgccacttatgtttctctaaaaaaaaggaaactacttttattcatgtaattaagagccccactcatgaacattaaagaattgttgcccactgtacttttggtatatgtagaaatataaaaccaaaaatgtatagtataaaaataaaaaatatacaaaaagtaaaaatataccaataacccagtaaaacaggattttgattggtatttggagaaattagctagatgtttatctgaatagattttttttgctttttagatatttaataattatagtaaattattttaaagtcagtatctgtactaaagtatgatagaagttggaatttatgttttgcagctattaaattttcttaagaacaaagtttgtttaaaccttacattcaatttcttcgtttgtgatttctttccatagtttctttgtattacaaattgagataaaattaaaggtaaacttaatttttttagtaaagcatttgtgattggatagtgttcaattaaaatttgttctctaaatggaaatttagtctttttcccttagcattagactttattagcttgtttgctgataaatgcttggaggaatctgaaaatgcatcacaagtttattagagatcttttatgtagttattaggttttctggctttctaattatcatatataggtgatgtaatcattgttgtcatgtttttttaatgaagattttaaatcgttttccactgtagacatttataatgtaatctatgcaagaaatgaatatttatctcagtattttaaaatggaaaaaataaagcagagagaaatcataaagcagagagaaatcattcatttcagttgtgaaaagttcagagatatgtttgacattcctttagtcttaactgcatctgttattcatgcttttctagataactgtataatattttcttttactactaatgaaatgtgattctctcatgtccagtgatgtgttttctgaaatgatataaacaaaaagtggttaatatgattttattaactgtgttgggactcagaaaatatcccaaaatgaaggcctcagaagaagccttagaagcaaggctttctctgaccttctcctgccctcctgtctcagtcgcattctcccccgaatctacccatagaaactagaatttgtcttccccaaggcagatcatagaaaccagaacccctttccccatagccagccataaaacctaaaagtattactctaacttttcctctgcctctctgtgtaaaaactagccagaagaacattgtctgacctacggtgtttgactgtaggtcataacaccctcattccagagagtgtcctcccttatacccagaaggaaggagtattgaatacatgcccagagaggccaggaagaatcctgctgggtttccgaactcagtctgttagcattagatcgtactgtctctgttcaatagtatttcttgagtgttgtccgtattttgttaatcttaagcataaaagtggacaacttccctagtatctttgggtcttcattatgaaggcctctgtgtacacgttaataaattgggatgcgatttctcctattcattgtcctctcatcagtgatttttagcataccttcagagggtgaagggggtaggtttcccttgactcctacaacttttaacacaatttaggtatttccctaattgctgaagttaccatatgaaatattcttattaacaacgtgttaggcttaaaggccagtttttgctgatcatgtcattatgtactggctgattttatttatttatttttagagaccagagtctgttgtgatttgaaatttcgaatttcgtgtcaattatgtaattccatcagaaattccccaaaggacacacctgtaatcccagcaccttgggaggccaaggtgggagaattgcttcaagccagaagttcgagaccagcctgggaaagaaagcaaggccctttctctacaaaaaataaaacaaatgaaacattagtcaggggtggtagcacacacttgtcgtcccagatacttgggaggctgaggcaggaggattgcttgagcccaggagttcaaggctgaagtgagccatgattgtgccactgtactccagcctgggtgacagcaagaccttgtctcttaaaaataaataagaaattccttggaaggaattaagacctgcagtaaatagcatgaggtgatgtacacttctttagtatttcttaatatttgcagagagcttgtctaaattgtgacttagttttccggttagggcctattcctaggttgtttttgcaaagaaagtttttgtgtatgtatgcctagcttttccttatccaatgacctttgtaaagactttgtattctccatctaacgtctagttacttaaggattttctgagcagtttgcttgaagtctgtttttccttcctagccattgacagaaaacacatctgccttagtgaggcccctttgatcttcagagagctttatctaaagagagattaagaataaatctgtcaggcattttcccaaagaaattgaaaatgcttcctaagatttcagatcaggtaggtaaagtgtttctctgaattaagacatacgaaaataagtatgctagtcaatggtttcatcctaagttatagattgcagagatttgcttctggcatgaaggaatattttttatttcacccgagacacaaaatgcatgcagtaatatcaatggccagaagcaactgcttttctttcattcatttttccatatttaacactagcagggtctgtggagaagatactagagagggtccatttgttctcagcctttttggggcttagcatcacaggaagaattttcagctggtctagtttgaatctacatactaaaaatttccaagatccatatgccaacctcctttctcccttcttctctccctcctttaaacaaatatgcacagaatgcttattttctaccaaactctgggttcatactatttactaggagcaaacctaacagataggtataggatctgatacactgtgtgcctcagagatagtcaaggtactaccctgaaaacgtgtacaactatttaaagatctcatgaacaccctcagttttagtatagaaatataaaatttgtaatcaaacaatttaatttttgatacactattttgaccttttaaagagttacagctaagaacagctaatgagctgttaatttagaaaataaaatatatacagaagtctgctttgaggttcttagtcagtaagaaaaccttggggagagaggttaaactaggtacgctggagacttattatgactttggcagtatgaaaggacaggaaacaaaaggaaaatcttacaaagagttatagtctgatttctgaaatgaatgtttacttgaaaggacacagaaaatagggtgccagcaggagaatccagttttccaaattccttttccgaaatcccaggctttttatgaaattttgagagaatggcttaggcttatgttttccattttgagctgcttagaagcaaatatcatataaatgcaaatttctactattatcatttactcaccttgtattatgtgcttaaggagttggagaattcagaagctgtttaatatacaaggcattgcctataaaatatttctttgtgacataatttgcttatttgataaacaagtatctttctttcctcctccttataaacaccccaaattagtttctgagttgaccaacaagattccatcagcatctggcaattattttatctgtttgaggactattggtatatgggacatgagttgctattatttggtaacattttgatgtccttcatttccttaattagtttaggaaaactatttggattttatgtacaagtgcttgctaattacttgagtcgtgagaagactgagtgaggtccaagtgtcctattaatccctttgagtctgaacattttcttataattggtttggcaagaggaataagtgagactagttgctaatgaggagataagtatgtaattttaccatgatataaagctgtgattgtcagtaagtggtattaggaatctagattatttttattagaacttatttctttctgcaaaatcattatcatctcctgatattgtaaattgggttatttcacaccattatttttaatatgtgttaatcctcaaactacaggtacttaaaaccttgctaattaaggagtcattaataaagttagcaatatgagccgtcagtttcgattcttcacaccatttagacgcaattcaattttgcgtatttacactatgttttcagtttggctcagatgtttgaagtaagtcaagagtaagaagtgttgtcaacttcagatccataggccagcttagcttgttttcaagatgaaggactgataacattgtaaagaaacagagaaaatactgcttttcttagccaagaacagagtaagctttgtatggttttactttttatagtctactcggcttttctgttcttaaaagttgcctggttatagtagtttaaaacactctttgggactttatccattgaacttcaatgttctctgaaacaaatattgaagtgttttgcatttgattttgaggaaaggtttattttccttttgaaaataatcaaactctttaagttgttcctaaccatagtcacttttacttgaaggatgcattatagtcttgagcattttttcacttttgtaatcggtatgaccctcttgtgtttttgctgatgagatggtagcagtgctgtggtattgtttgcaggtcctttcttatcctttatctgtgtctccttcccactgtgttgtgggttggtaaatgcatagttccctccattactttttcatggctgaagggattgtaaatattgttttgcatttctagtttttttagatgtccatagaattccatctttagccatagtgcttttataattttgtaatacctttgactagctggggagggggtatagataacagtttagtttccacatattactcattttgtgcaattttattgtgcttctgatatatgcccagtatgctattaggtgctgtgaaggaaatggaaaaaaaattagtaatttttcctgcctgaagaggtttacgatctaattagagggacaaggctaactaaaaagttagaaaacaatacatggtgaagataatgtgttaagatatgttttaaaagaacaaatttatgagattattatgggtgtatcttaatagaataattataactgataatagctggttctacatttaggtaaaaatgattacttccctatgtcaaggcctgaaatacacaggatgttacattttgaattttaaaacaaatcagtatctcattaaactttatggaacaccatgaaactttcaaaatttagaactttaacctagattactgaatttgcatttgaagacactgaggccagtgacgtcctggagtttcaggtctggctaacagtaccagcatgagaacatagggtaacagcaagttgcttgccgtagttttaggtctggcttacagtaccagcatgagaacatggggtaacagtcaggggcttctgagtagttggccgcaggaggtaaagctagtaagcactgctaacataataaaatgaaaggcattgcacacagaccagtggtctgctatttgaccctttcccttcctcctcttctttttccccattttccttttgctgctcttcttccgccatcatcatcagcatcctgacatttgcatggcttcttacgattttgaaattgttttcatatgtacacatttaccggagcatcacaacagccttgtgaggaaggtcagcattgactctgattgaagatgagaaaacacacctgcaaaccagtgaactaatttacaagagtaaatggagcaggacctcaaacccaaatttcctactccaagcctttcactgtacacactgcctcttagaaggctggttccaccccaaatcctttcccaaactggggaatcaattagaagaacaggtagaaaacaaggagtgaagttgtgttcaaatgcttacaataattacttggcttgtaccttttaaaatactttatagatttacttcttcaataatccttgtagatgtgtgtttagtgtattgttaggaattgtatagcatttacaaaagtctaggctggtttaaaccagtagtttgtggagcttttaaaccctgagagaccagcctctagataggactcttgcagtatgtgggacgttggctgtcctaaatgacctccaaaaaggccttttaaatctactccttgcttccatgtgctttattcatgactaccttttatttcctgggtccaggtactaatacatcttgaattatttttttttttccattttatctttctagttaccttccttctacttcttgctgctgcctcctacacagagccctggctcccacagtaggttaatatgtgtaataatgttcagggagtgtgatgaacatgagctgaaaattttagaccaccgtatggtctgcctatatttttctaatttttttttcctctccaaattcgcgtatgttcctagctaccacagcagtgaagggtagtggaaggaatgtggactttggagcccaaatagtttgggctgaaagaccaatcctttcaggctcaaatgcctcgatatttttggacatccacctttaacctgtaaaatgagggtagctgcctgccatgtggtatcatgcgcctgtccctttacctgtcaacttgacatctctaccagatggtgtttttttttttttttttttttttttttttttgagaccgtgtctctctgttgcccaggctggggcgcggtggctcaatctcggctcactgcaacctctgcctcctgggttcaaacagttctcctgcctcagcctcccaagtagtggtggcgtgcgccaccacgaccagctaatttttgtatttttagtagagacggggtttcaccatgttggccaggatggtctcggtctcttgacctcgttgtccgcctgcctcagcctcccaaagtgctgggattacaggtgtgagctactgtgcccggccatctctaccagatgttttaaagacacctcacatccctcctgtccagtaccaaccccagtatctcaccactcagtctctccctccagtcccttggcctacccttgacatgttcattgttctttaattcctttaacagtcttctatcacattggacgtttacctctccctcacactttgtgtcttacctgttaccgtcttgccacctctacttcctacatttctctgtaacccatccatgtctttccacctctaatgtcatcatattcaaattattgccatctcgcacctgggtcattacttctatttttattttttgagacagggtcttactctgtcacccaggctgcagtgcagtggcatgatcatagctcactgcaggctggaactcctgggttcaagcgatcttcctaccacaacctcttcaatggtggggactatataggtgtgcaccatcatacctggctaatgttttaatttttgtagagacagggtctccttatgttgtccaagctggtattgaactcctgggctcaagtgagcctccttcctggcctaccaaaattctggaattgcaggtgtgagccaccgtgtccagccctgacccattgtatcatcctaactgatacccctgcattcacttggtactctcccgtccattttccacatggcaaccaggatgataattttaaaacacatttaatcatgatatcctcttgcttaaagctctttgattccttccccttgttccattctctcccttatgtagaagctgatgactagttagttccagggtctggaacctgaactctccctcctgctctttagtgtcacttgcttcttgttgtcttcaaggcctggcccttccttggatacttgttctcccctctgtctggaagtgctgcttcttgctctctggagccctccccagccctgccccttaactgccccacctattcgcactggttcatagcagctcattctccagtcttcctcctttgagccccctcgggtgtggggctcctccagagcagcgtttccacccttggagcacgtctctctcacttggtgctgcgatgacttgatttcgcaaaaatcaagcaggacaaaggagatgcttcacatcctagttttctttttcctctaacgtcttttctaattgtgaagtttattttgattattaatgtttcattggaaagaaattatttctcattgattgtataaaaatcaaatgacatgattatgttatggccaggttttccccctccagatgaaagtccaggggagaatggtattaaaagtaaataaatttacttaactctcaagtcaagatttatgaatcattgactcaaaagaatgaagtatattatatttgtacaagacagtcttccacagatgcacggtttcatagtggaactgcatttaaaaatcacctgagctgcctctctggctctctgtggcatcatgtggtacttcttattcattgcgacatgggattcctgcccaaaccattaattaaacattttgactttccctttaaaattctgttagcatttagtagctttaatttagttttaaatgctgtttatacttcctgcttattatcttttggtaattaaaacttttcctattcatcatcaaaaagtctgtatttttaaaacccatattttaaaactcaatttaaaacctattttcaaacaatttctctctgttttagattaagtgactaattttctttatattccgtttcactcatgaaaggttttggagagcttcctaaaaggtacgatatgcatatgaaaactgttcctgtgctcttactcttctgatctgctttcaccttttatggctttctttaatgccagtgacttgaacattacacaggattccatcacccacagctgtttgctgtttatacatagacaatatttttcagttgccgttaccgctcctggtcgcatctaacactaccagggctatgtcttcagcaaaaggtgagtggtagttccagtacttcttttcctttaaccagacattactttttcctagattattatgccattgttctcattgtaatctatttctacatttctgccgaatgatacaacttagtgaaatcttctaataccttattaccaaaaagtttggggtcatataggactttatcattattttgtttcagaatacatatgtgttttctacctatgccattgttttttgattctgttaatggtggatttattttatatgttgaaatttagtatttttatatagttaattttgtcagtcactttgtagtgaacttttccaacctcgaattttttcctctgtaaccgttcactgaggctggagtttggtttggatgacctcatccccaggcccagcgattgaccctagtcatacacccagcaaggtggctgactgggaactcaggcctaatctaactagcgggtggtattcgtgactattaagagatgggtgtataactagggcttttggcagtaagtggggaaagaggaactcctctaactggtgaggcatgcaggcctaaggacggagactctgtaggcgtgagggaagccatatggctgaagaagctagcatgtgcaagaagagggcagatttgagagaatggcagagaaatggaacaagactgatcaaatgagtctgattgtgaccttcctctgtactttggaattacatgagccattaaagtacttccttgtttaagctagttgagatttcctatttgtagcttgaaatatcctaacacttcatttttgctttatggttttctccttttttttttttttttttttttttgagccagagtcttgctctgtcgctcaggctggagtgcagcggcgcgatcttggctcagtgcagtctccatctcctggcttcaagccattctcctgcctcagcctcctgagtagctgggattacaggcgtgcgccaccacacctggtgaatttttgtatttttagtagagatggggtttcaccttgttggccaggctggtcttgaactcccgacctcaggtgatccactttggcctcccaaagtgttgggattacacgtgtgagccaccctgctcggcctatggttttgtttctttcttttttctttttttttttttaagagatgggggtctcactctgtccaccaggctggagtgcagtggtgcagtcatagctcgctgcaacctcaaactcttgggcttaagggattctcctgcctcagcctccttagtagctgggacttcagcacacactaccacacccagctaatttttaatttttttgtggagatagagtcccactatgttgttcaggcttgtcccgaacctctagcttaaagtgaacctcccacctcagactcccaaagcacagggattacaggtgtgaggtaccacacctggcctgctttatggttttttatatataaaacgtatcatgagaagttggatggaaattttatctgtatttcctcttactgatttgttcgtttcacaggtgtttgaatccttacatacagtgttttgtcctatggtgtgtgttagagatctgcctttactttttttcctaaacagtttcccatatgtattgaattatatccttcctattgatttgcaacatactccttaggaaactttaggctgttggtgaattttctgttttgttccactaatctgtctttaaatcactgtatcagtaaaaaattataaagtattatccttttgtaatatattttaatgttttcagggaaaatatccctcattattttcctgaagtttcatggccattacctcccctttattctttgggattaatttgggagttattttatgttttatgaaataacttcttggagttttgattagaagtttataaattttataaatgatgagagtgttgacttattttttgagatagattcactccatcccttttaatgtattttaggcataatatattattagtgctcttataaatgagagcttcattttcttatttttcaatttggggaaaatttttgagaacataactatggtaattattagaaaaataacctaggagtatcatatttacatattctctttaaatatattcaactttaaaaataactttatttttaaagttgcatattcagttatcacaaattttatgtgtatctataagtctttttgcatttgtgtgggcctttttctttgttcttgatcaatgttgctggaggtttattgattttattagactttccaaagaatcaaaggttttattgaattattgaatctttatttatttttgctcttttattatttccttgattctacctgattcatgtttatactgtcgttcctttcctaattgttaaatttgttgaatttgatgcttagcttgtttattttcagcctatattcttttatcatttgaacatttaaatgtgtacgtttttttctaatcacttgctgcttagttccaatatatggtgtttttattatttttcatgtatactttagctttatgatttcttctttaatcagtggattatttagaaatgtgtttttatgtgaaaaatgtcataatgttttttgaaatactgatttctaacttgattgcattgtgcttagaggacttgaggtgtattaaactgattgtttagaacttgttgagactgacttcatggtccagtatgtggtcacttttcataaatgtttcacatttgcataagcatatctattgttcaggctgggtgtggcagctcacacctgttgtaatcctagcactttgggaggctgaggagggcggatcacttgaggtcaggagttcgagaccatcctggccaacgtggcaaaaccccgtctctaccaaaaacataaaaattagccaggcctggtggtgtgtgcctgtagtcccagctacttgggaggctgaggcaggagaatcgattgaacccgggaggtagaggttgcagtgagccgatattgtgccactgcactccagcctgggtgacagggtgagactgtgtctcaaaaaaaaaaaaaaaaaaaaaaagaatatctattgtccaattggtggatacagggctctaaaaatatctgttaatcatattgtctaaattgtcaatatatttaatgattgtttttgctctgattagcaattagtgagatatgttaaaattacttcactaaggccaggcatggtggctcacgcctgtaatcccagcactttgggaggtcgaggtggggggatcatgaggtcaggagttcgagaccagcctgggcaacatagtgaaaccctatttctactaaaaatacaaaatttagctgggcatggtggcgtgtgcatgtagtcctagctactcaggaagttgaggcaggagaattgcttgaaactgggaggcagaggttgaagtgagccaagatcgtgccactgcactctggcttgggcatcagagcgagagtccatctcaaaaaaaaaaaaaaattttttttttcattaaatgagagacctctaattttctcctagttctttcaattttttctttatatgctttgaagctatgttattaggtactgtgataggcagaataatgccccctcacctgtccacgcccaaagtaaagatgtctacatcccaatcgtcagaacctgtgaatatgtccctttacatggcaaaggggaattaagatagcagaaggaattaagcttgctgatcatttcgttttcaaatacagagctaatcttggattatccaggtgggtccagtataatcacaagtccttaatgtgaaagaagtaggcagaagaagagtggtgtgacatgagaaggattcagcaggtcattgctggctgtgaagatggaagggggcgtgaaagctagcggtatcaacacagagtggctcatgtgaaaacctaaggaaatggagccgcgaggccatgaagaaggcgccctcgtgcacatatgctcatgtaggaactactggaagaacttccgtgttccggataagctgcctgcctcctgcacatacgctcatgtaggaactactggaagaacttccgtgttccagataagctgcctgcctcgtgcacatacgctcatgtaggaactaccggaagaacttcggtgttcccgataagctgcctgcccatggacacttgcctccttccagctcctgcaaccagagagctttgtctcaagacagctcatgtggacttctcattttttccttttaaaagcttctcttgtctcagcctgtttggatatacctatgggtctgccatagcgtgcatatggattgtagtcccctgctattcctgaataaactgttttggaaagccagtctctcgtttattttacgttgacaggggctatgagtcaaaggatgcagggagcctctagaagcttgaacaggtgaggaaatggattcatctctagagcttctggaaagaaaggcagctttgttggttgtagccagtgacgctggcatcggacttccagttagtgtttctctggtacatctttcttccttcttttaaccttctttctgttggtatccttgtgttttaagtgtgtctctggtaagcattatgtatgtgcattatgtatatagattttgaattttttacctattctgacaatacttgttttaaatcagagaatttcaaagagttatacttactatgattactaatacatttggaattatttgaattatttttaccattttattttgtcctttcactttttaaaactattttacttaaaaaattttaagaggcaatttaaaaagttgttttttgggcaataatcctttacagtaggtatttttattccactttgcagctgagaaaactaagacacagagggttaagtaacttgttcaagatcacacaattagtgtgtggcagaagctggacttgaactctgttcatctgactgtagtgactgcatatcatcctggtacagtttcgtttattgagtgtgatagatttaaaaaaggcagaattgtcagtcaaggatgtgccgatgtcttcgatgtactcctctagatatgccctctacacgctgttctgtgctcccagagtctgacctctttggactgttagtgagcctcctgcctggtggctaccaactgggtccagccagtgagaaacgagggcaaagaattaggtccaggtatttattctgacccttgaaccacccttccttcccacatacaagcccttcctgtgtacagggttacctcagggctcactgtgtcccttgggaaaggtcacggctcgtgtcagggaccctgtccactctgtcctctcagcatctagtttctgcttccctgctcttatgccttaaggcctaggggtgcaaacagcagttgtcatttgctccagggcatggcattatttggttttactaaactgtcctaccttttgtgaaattccctttattaaatgctttccaaattatccctgttgattgcacagtctgttttctgccaggactctgactgatacagtgagaaaggaatgcttaatcaaatcagccgtcctttatggaaataaattattaaagccctgcctcacatcaaaaagcaaagcttgaaaaaaatataataagggattaataatcaaaacatataaaaatgtcaaacatctattaaagaaaaaaggcaagccatgcaaaagtaaagttcagggacatatcctaccagacattgtaaagctataggaataaaatagggtaatactggtgtgtaaaaaacacatagttttacagtctattcatcgatcagataccttaaactacctacctactaacaacaattaaaaatattagaggagagatgtaaaaaactattgaaaatgtatttctgaccaggcaagagaagacggaattggcagggtgaaaaagggcaagccagactctagggagggcagcgagctcttagactgccttcaccgtctttctgaactcaagggccgggagtgtctgctttgatggctgcatgggactccggagataggcaataaagcccatggtttctacaaagtgggaagctccaagatttattgctgaataaatctggaaccctaaagtccgtaatgtaaaaggtgaatgagaaagaaatctctgcgcagaagagagaaggaaacaagccttaactcactggagtagcaaggaaagcgcttctctgagaattgatgaccaccagagggcctcccacaggtcttccctgcacattcctgctatcctactggggaggtccaaaacaacctccagcaaacaattcaacgtggtcttcaagtagttgtgtacccaggcaactggcaaaaacaaatacaactcctctctggaggaaagcagcttccacccaatattcaaggcattactgaaggcaacaaaacaggaaaacaggtaaaggattctcaggcaactcacaggacataaaatgtacatcttgattacgaaataatctgtgtaataagcttagaaaattgcctgacacgtaataagtgctaagtaaacgttagctatgatgatgctggtgacaacaatgatgatttcaagtctttttaattctctcctattaattgatttctcttgctttgttaaaatcacaccagtttaattaacacttgtcatattgtaaactttttaaaatgttcaaattttttcattgttctttttagaagttttcttacatattttatgtgagttttaggattggcttgtcaagttcctgaaaaatcatgtttgaattttgatgaggataggggttacctttatagattactttgttaaaaactgacatctttacagtattgagtcctagcatttctgaatagagtatatcttttagtttattcaggcttcttttatgtcctttagtcaagttttatagttgtcttcataaagatcttgccacctttttttagttttatacccacttttccatttatgttgctctttcctattaaatgcttaaattggctatattgaagatgtaagaaggctgttgagttttgtgttcaccttgtatgttttgcgcttgccaaaatcccttactttttctgattgcctctgattttctaggtgaataatcatattgtttgtaaattgtgataatcatttccttgtgaatatttctgtctctaaatttttatcttattgcaatccctgcaccactacaatgcgggattttaacaagtggaacagatatccttgttttcttcttcattttaatggatgcttctaatattttaccattaaatgtaatattttctctaaatttttgatatataccttttatcagaatttgctaagcatttttgttaggaatgggtgttcagtactattagatgatatttatttcagtctctgatagttacatgatgtttctcctttaatacatgactatagtaaattcattggaacatttcttttttctcctctttatcattaaaatgtttatatatacgttggataagctctacatggccataatacttgtctaacattttaaaatttatttttagtttttaactaatacataatagttggacatatttatggggtacatgtgatattttgatatacgcatatgatgtgtaataaatcagggtaattgggatatctgtcacctcaaacatttatcatttctgtgtgttggggatactccaaatattctcttgcagctatttaagaaatgccttacttcagtatatgtgaggggttgattccagggtcccctgtataaccaaaatcgaagcatgctccagtccacaggtggccctgccaaacccacggatacaaaatttcaccttctgtatccatgaattcacatccctccaatactgtacagttttgtaggatttgaactgcatgggtccatgtatacacacattttttttcaaccaaacatagatcgaaaatacatattcactggatgcgaaacctacatatatgggggctgacttgttgaatatgaggttccacaaggccgacttcgggacatgagtgtgtgaggatttcggtaaacatgagggtcctggaactagttccccatgtagaccgaggaacggctatattttcagtttggttggaaaaatatccttgtataagtggatcctggcagttcaaaccagagttgttcaaggattaactgtacaatagttaactatggtctcctgccagtgctgttgaacactagaacttattcctttcctctaactgtggttttgtatccataaccaacctcgcctcacactttcctctcccctgcccttcctagcctctgggaaacactgttgcactcactacctccacaagatcggttttttttagctcccacataggagtgagaacatgggatatttgtctttctgggcctgactttcgcttaatgtcctccagttataaacgtgttgctgcaaatgacagcatttcattttttcagtggctgaatagtattcctttgtggaagcataacatattttgtttgttcattcatctgttgatgagcatttagcttgattccatatcttggctattgtgaatggagctgtagtaaacgtgggactgcaggtcatctgtttgatagactaatttcctttcttttgggtatatacccagcagcggaattgctagatcatatggcagttctattttccatttctggaggaccctccatactgttttccataatagttctgccaatttacattctcaccaagaccgtatgaacattctttttctctgcatcctagccagcatttgttattttctgtctttttgataatagctatcatatctggggtgagatgaaatctcactgtggttttgatttgcgtttcttaatgactagtgatattgagcattttttccctagacgtggtggccatttgcaggtcttcttttgagaaatgtctcttcagatactttgcccatttaaaaatcagattatttgcttatttgcgattgagttgtttgagttcagtgctgggttccaccgtggcagggctaacacctagttccaatgccaagtcccacactcactttgctttccctaccccaagcataggtgttttccctccaggctgtgctgcctggggatgaggtaccagggtgtaggtaatgtgagactgtcttccctacccctttaaatgcatcttttcttgttaagctaaaaccaggtcctgtcatctcccatctgatttttagctgttatgaaaatgctttcttgtatggatagttgttcattttgatgtttgtgctgaggggatgatctttggagggttttttttttttttttttttttgagccatcttgctccacctttctctctggtaatttttaaactttatttaaaaatgttccatctatattcataagtgctattcccacgtaagtgtgttttcttattatatttatgaatccaactatggtggctttctaaaacatcttaggtttttaaaaaatcttattctttgtcccgttaggacagtttatataatattggttttatctattttttgaagatttgaaaaactcttcattaaaaccatctatgcctagtgcttttaggacactattaggacagtttatataatattggacagtttatataatattggttttatctattttttgaagatctgaaaaactcttcattaaaatcatctatgcttagtgcttttttcccccctgagttaaattattacctgtaattttgatttcttctatggttatttggtcttttgttttcttttttcttatgaaaattttagaacattcttctagtatctgttttgcttagcttttaatgttaattaaaattatatggagttaaattttaaatctttaatatctgaggttgttttcttttccatttctattgtactttatttggatcttctttcttttttcttagttagacttggcaaaacttagccagttttatgggtcatttcaaagaacctgggtttcaaatgtgctggtatttttgtttggttttctaattcatttctttttttatgtctaataatttattctactttcctgtttggttttgtttttacccccctaattttgtaagttataaactaagtttacttattttcaatctcttgtgttttctggtaaatgcattttatgctatgattttttctgaccctgctgtggctgtttcccagtctttattttgtgcgctttatttgttatgtatgtatgatgaaaatggaaatttttcttcagtttttttttcttcatcccaaagcacaagtaaggcgttaaatttcaataggtagatagatgtagagatagtagatttttagccacgttttaattttatcctattacatttattttaaaagatttggaagacttgtatttttttaatttgtaaatatatccttttgtcctaaaacttagataatttttgtgaacattccacatgtttgataagagggtgcattactctctgcctctcttaactgtcttattctctaccagtttatcttatataaatattaaaactattattacatgtgtaaaggttatatttgctttgctaagattgtattagctatctttttatggtctggaacagaggttggcaattttttcttgtaatgggccggatggcttctgtcaaaaccactcagctcgccattgtgttgtgaaagtcgccttacacaatatgtaaatgcaagtgcagctctgttccaataaaattttatttacaaaaacatgtggcaggctagaattggcccactggtcttagtgtgccagctcctggtcagcataagccttatgacactctgaaatttagatattaagtttatgtaatatcgtatatgtctgttaaccttttgggtagtaatttgttgaaaaacatacaactttacccattattttggtatttctggtattctcccttttgaatcactatggaaaatccttatttttctaaaccatcgtacttaacattaatgcttgtattctcaacaagcacaatattgtgaaaattggtttgggtcaggaggaggaaaaaaaaatcttagaaattgcaatggctgtgcatggtggctcattctggtaatcccagcactttaggaggccaaggtaaacagatcacctgagcccaggagttcgagaccagcttgggcaacgtggtgaagccctgttactacaaaacaaacaaacaaacacccaaaaaattagccaggcatggtagcttgcacctgtagtcccagctattcggaagactgaggtgggaggatcagttgatcccaggaaattgaggctgcagtgagctgtgatcatgcccctgcattgcagcctgggcaacagagcaagaccccatctcaaaaaaaaaaaaaaaaaaaaaagaaaaggaattacagtgtcttgtggctctccaaagctcagcccaacaaaatcataccttagcatttatttacaagcggagggtgttgagcaaggcaggttcctttgggggttgataatgaaaaataggtaaggtattcaagtttattaatgtaatgctcttttaagtgtttgtagcatctgtgtctgtggtattgttgctacacattttgcttactcctacttttgcaatttgtattttctgtaattcttattagactagaggcttgtttcccccacacctttcaaagaagtctcttggtctaatttttcagttcaactcttgtgcagattcatctctttaccttttatctttactttgccattgctgtgtgttttccgatgcctttaattgaatgactaatttgttttctgcctcccgttccctctgccactcctcctccccaattttatgctgtgtcttttcctctaattataaatctgggtttatttgcttttttcttttcttttctgtgctttctctttctttaacttctttttttgatatgcagcgtccttactgtcgttattttctaaagattttgtaattgcttgtttggcttctttgagacacgatttaatattagtggaggatttttaaaacatttcccttctttagctatttttggtttgtatttttgtcctgaatttcagtttttattgcattatcttcagaggctgtgatccttataattaatcttcttttgacttgaggcttagtttgtggcaacatatgtcatcaagttttctaagtcttccatgatcacaaaatgatagttgaagtcccttacaatgctcatcagctaggatgctttcagcttcaggtaatgaaaaaccaactgaaaatggcttgaatagaaagaacatttattatctacataagaagtcctggagtagggtaattttagaggttgttaactgggggcctcagtagcatcatcaaaaacctacattcaattcttccctactcaatctgacagcttggacttgtctcataggctggctgtcctcagggtctcaggatgacactcacatgagaggttgcatgtcccctttctagcacttctctctttcccttcattcctccctccgtgtgtgtgtgtgtgtgtgtgtgtgtgtgtgtcattcacagaagtttctcttagatccacagctctttcaatgagtggaatggtgttacatgtccattcttaaaccagtcgttgggaatgatatcaccaggggtagtagagtgcaatgttgattcatggcttgagggccagtccaggctagcgatacagagtgggtaatattctctccctgcagacatagcccctggacccaagtgaacagaatcagagttctcactgaatttaaggctaggggtgggtgcaggcaggtacagggaaggcagttaggcaggcaccagtagtatcatctgcacagttgaatactttattagccataacaatgtgcaaacaatccacacacttcatttgggatatttattccttcaggtgtaacttaagcatcttttttgactctaaacaattgagcgtattgtggaaattttccggtgatttttgtcttaaataagtaattgctgcagcgctgaaaattattactataaaattctactcctgttagtatatcagatatatatatttttaccattttctttataattcagaattttaggattttgagcagccagacattgtgttgtctttattgttcttccagcactgagtgctgaatttccagaaacgaatggtaataatgaaaggtgcatatctggagatagatggaagtgtaactcaagatgtgattagctacccagtttgtttttattaaaatgttatttttttctgcatatttgtaattcagggaaagtttctaatgtgaaaaataaagtagcttttcttaaggcaacgtataaaaaataattggtttaacagcattgtgtgaatacagatgagatggtcctattaaaatttgatcacaaagtatacatggtaaatgcagcaagattcatgctaactaattactatttcaagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgcttaaacagactaattgaaatggttgaatgggtaagaaaatgctcccttgaatccacatccttaaatgaggccaggcagacttggaggggtctgtgagcccctgagctcctgtcttacagtctcaggctattggagggggctgcacatcccacatttgggtagatgcccaaattctccttttagtatatactctcccttttcttgggtgttcttggaactctggtagaagacagggagaatgatagattttccttgccctccacagacacaggcaaactagtttctgttaggcattcactctgtgtaacattcatcccaattgcaatggtgatacagctaccgtcaacagactgatcaccttgcctgtgccatgtgccctgtgcacatttactctagtcttcacagtaacctccagagaggtgttatcccattttatagattacagccgaaaaaggttaaggaccttgtcactgaactgcccagtagaagttcaagcatatgctcatggaatttgattttacggaagtatgtaccctttagggatctacagttaggtgccctctagggtgtctagaattgctgaggagcccatcgttccttaagcacctgtgctgcgttgtattgtaatcacctgagggtgctttaaagactatgaataatactcagactttcttctccaaccatttacatcagagcatctgggggtggaacccaggcatcagtattttgcaaagttcccaaacgatgtcagtgtttagccaaatatgagacccactggtttagagctgtaaacagtgcagttgctactgttttatggtagatgttacagaaatatgtcgttgaattgcctataaaatgaattaaagattggagcatttctttttcccctattcataaaccattgtgatcgcagtcttctatagaaattacctattttgcctgatgagatttacttagaaagggaaataaacacatagctatatctctcctgaagtcttcttgcagttactaattaaggcagtacacacattctcagttgagctagaactttagctattgtctctttgctctactgaaggtaacccgagtgttacggctttttaaatgagctggaacaataaatacaaatttcgttggcaagacaaatactttttctcatatgccaacgattatgtaatcaaagtataaagtatccatataaagccttgcttttgaaaataatttcaatttaaaaattaaaaatagtaattaacattggtaacagtatattgatgaccactgtttagctgatacagtgaatacaggtgttcatataaaacatcatttaaaatcgtctatccatatggaacacattacgttttcttccaatttacattgacttcctgttggtttctgaatacaactcaaggtgttaatttcgttttcaaagccagatgttatttggcaggataaaacttaaatttcccctaatagatatttttaggcacttaggatgctagggaacttagtaagtgctttttaaaatctagagcattttcaaaatgctcctttctgttcagtctttcttctctgctaaaattgttatgtgctaggggagatttgtgaattttagagtaatatctttaagaagcctgacagagtagatcgagaccatcctggctaacacggtgaaaccccgtctctactaaaaatagaaaaaattagccaggcatggtggcaggcacctgtagtcccagctactcaggaggctgaggcaggagaatggcgtgaaccggcaaggtggagcttgcggtgagccgagatcacgccaccacactccaacctgggcgacagagcgagactccgtctcaaaaaaatacaaaaacaaaaacaacaaaaaaacctgacggatgtcagtgaaattgggggatactaaataaagagtggacagcagtggcggggcaacaagcagttcttcagtgttcctgttcctcagcgtagccaacttggtcctgtatctccacagttcacaggtaacaagtgccctgttgcttcctggttgactgatgctctctctgttacataacatccctgacaacctgttaagtttgtaattattgaacaaagtcccacctcattggcaataatggcaaacagaacgatgcagctgtttagcttgctcttgattgaacagaggacataagttggctgttagttgactaatgactaaaattttgataaagataagaaaacactaggcatttgagattcatgtaataagtagcttatgcatgtactgtattcaaagagaagatttattttatttttttatttttctattttttgagacggagtcttgctctctcgcccaggctggagtgcagtggcgtgatctctgctcactgcaaggtctgcctcccgggttcacaccattctcctgcctcagcctccccagtagctgggactacaggtgcccgccaccaagcctggctaatttttttgtatttttactagagacggagtttcaccgtgttagccaggatggtctcgatctcctgacctcataatcctcacacctcggcctcccaaagtactgagattacaggcgtcaaccaccatgcctggctgaagagaagatttagatatatgtctgtctgtccatccatctccctacccttcatctaactgtccattcaggacatttcttcacagctaaactctacctcagtttttaatctttaagtccagagctcagtccattgatttactgtattcatcagattttaatggatgcttatagttttgttctcaaagaaaattaaaaatattacttctagtgtggtgtgctgttctcactgcagagtactgtttgttttgtttttaatttacatatatttactaggaagtgcccacactgataaaacagtcagtagtaatcaagaaatgtgactttcttgcactattatttaactaaaggaaagcagaattatagaaaagaatgttaggaatgttatcttcatgagtcagggcttttgcaatgctaggccttctcactttcaatttctctcttgcaaggttaaaagaattattcttgtgttaactcacaattactgcatttgatcatcctttctcacttatgacatagcttctatgacttatggaacattggatttgctatagtagaccagtctgaatctgtctctacatggaatgaccagattgaattggcaccaaagttccactacaaatccttcatccagtcttccagtttgaattggaaatatcaattcaagcagctcacaagtcatcaaatgtttcagtggttttgtatagccagaacaggcagaagaatatgttcctgtatagacagttcattgaaacagtttattctgtattatacctaggtgagttttgaaaagtcagattttttttttaaggtaaactctgatctcatttatttagaagtcagacatgttccaagaacctagaggaaagcaaagtgaaacctccctcctccccactgccccaacattcaaaatagctattataaagccattttttatttcattaggaaaacttttaggagcttttattttgagtcagtgtttctattttatatatagttttaataacttttgttattttaatccagattaaagatagcaatttagagatgggtagagcaggtcattagaaatgatacgggtatcctacctggaacagagtgaagaaattttagtcttgggacatttagggtggtggcaaataactctgcagtgtaacagcgcttgaatacaatgatgacttgtaagggtatcaacattatgggaagacagtgttagaaattacagatttgtgaaagaattttttttgttttcattttctgagaaatagatatggggtgcacagtgatgttatgtatgaagtgtgggatgattgaattagctcattaacatattcatcaccttaagtacttagcatttattgttcctgtctaactgcaactaccaacccttcctcatctcccaacaattatgttttatatactctgttaaagaagtcagagaatatattgggaaaacactgaagtggttccaattttaacattgtgtttgagagcaaatgtttgttaagttttggctaattaggtcacctcattggttgattatgctgtgtaactgagggatttctacacacggtttatttgttaaaaacttaatgtgtataagaagtgatgtgaggatttctttacacttctgctcccatggtttcaaatgtgtctccttctctctatctgcaaccatgacctccctcttgagttacaagccattatttcttatgggttaacagttagtgcagctgttatctcctgtcagaaccataaacctggtgttgattccttcatctaatttcttcaatttgtctctctaaagtgctgttactctggggtattccctgtcttggttgatgacagatgccaccatccgtcagtctctgaagcttgaaactgcagtgtaacagcgcttttcttagttgcacatcctcctgatcatgcattgtcatgaatccctcagaactgtcatttcagcgaggcccctttctgttctgagctggaaagcataatggttctttttttttttttttttttttttgaagcggagtctcgctctgccacccaggctggagtgcagtgttgcaatctcggctcattgcagcctctgcctctcaggctcaggtgattctcctgcctcagcctcctgagtagctgggattacagcctgtgtgacgccacactggagtaatttttgtatttttagtagagatgaagttttgccatgttgcccaggcaagtcttgaacacccagcctcaagagatcctcccgcctcagcctcccaaagtgctgggattacaggcgtgagccactgctctgggctggaaaacttggctctgatgctgtccctgtgttcaggctctttgcaacattgatgaaattactcttcttaaaaacaaaagtaatgatgtcatgcttcccataaagactgtcaccaactactccgtgtggttcctgcgtcagtcttcagtgttagctccctccctgccctctccacatgccacgaggcgagacagcaagtgctcctttgtcctcgtggacccagttctaccacagctctctgcctttgcacgagctggtcccgtggcctgggtgctcctacaaaacgctagagccaggaagagagatgccagcggtctcctgagttaataccgtattctaacgaagatctgtttcacacttttcaaagcttcagttcacagattccagaagaattttgcatacaactagaacatacttatcttttctcagtggcccgtcactataacattaaataagatcttaattgtaaaacacacttaagtgatacactttttcccaggagagagctgataacggtctttaagagcttggaccctggagatgcgtagtgtggtcttgaattcctgctctggtgctgagcagctgtatgcctttaacttctctgtcactgctgcctcctcattgaaatgaggctagcagtgggacctgtctcgtgggatcgctggagggtcagataagttagcatatctgaggctcccaggatagtgtctggtgtggaagcatgtgtatgttttagctgctgttattatcattagtttcaattccctggcaatagcactgtttggagtctcactgtgtattatttaacagattctgaataaagccattttatcttctttttattctttatagatgataaataatgttcctacaactcgaggtatcacgctgtgtttttaactttttttttttttagcattactgaaagaagttgtatgtactttatcttattttgctccctaattataaaatacagggaaaatcatattcttttgcatgaacaaatgagctatttgaaacaggttgcttggtgaaagtgaaaatttaaaacaggattcaggtcaagtataatatattggtttacacttaacagagttcatagtgatttttatatgtctcctttctttttgatgaagaatgtctgtgttccgactactttacttctccgttcattttcatttgttacattctgaaagcataaaacgtgccattggttaatcaatttagtctagtggaggtacacaaattcaaggtaaatttggctaatttctcctgcaggctagaagataaaatcctttccccccaccacagttaggttagtagtgcttgacgtgatcagatgcctcttcagaggtcacctgatttaattgtggttgtgaagcagccaatccaaatccccatattttaatttctatccctccacattctcggcacagaataattaagagtatagtttttgcttatgtcatttatccagtgaaaaatgttcctaataaatacgtgacagttaaaattgttctagagaagaatgtttattaacagacaagacagtgcttattgccacagcatcattttaatctaagacttaactaaaaagagaaactctttttagttagaagaatgctccaacaaggctgttaccactcagcgaaggcaatggttactcttttattttttaaattggtttgcccctaaggtaggcattcccagggctaaaactgtgaaataaaatgtacgcaaggggactggtgcttatagatttgtgtgtataaatgtagtatttgtgggaaatgtcaagctatgtactcttctttaccttttattttctcctagatgatgtttatcagtctttttgtagctgtctgctgcagacatcattgcgtctttattatgaaagtgctatgtgtagctttccagtcattgctattcgagagtgagtttgtgaagcagcaggagagagatgattttgcaaattgcaatataataccatatatgatcttgtctcaacctgtaacacacacatcttcacagaaataacatttaattatggtaatatcctccctgatatcagacacagtatggcgcctgttaagattatattgtttgtagtaagatggagtaaaagaggtttaaaaatgaaagaataaaatcacataccttgataaaccccttagatgctatttaggccatggagagcttttgattttgtttcctttctttcttcccaaaataaaaacgcacacaataatttgacagacaaacactgtcacacactgtaaccccatctaatcccctcactgcacatcttaatccctgatggacttttctcagctatgtgggctatgaggttagggagtttctggatgtgatactttttccaaagtttcccagtgacagatgcagtgaccttatcacggagacagctttatgcagtttgacagttcagccatctggcttgtatcgattataattgatttaaagaaactaacactccaaaagttggccacttaaaaccctaaggctaaattggtctacatttaatttgaagtttcaaaactttattcttaaaactaatttgggcctctttgtaaaattcagccaacttcttttctgtgtggggttttggggtgaaaacactcaaagcctgccttgaaaaaagtcaacttttatgagaactaaagacgacatgtgtactcatagacatagattttatctcttcttagattttgctagagtttaaaacttaggtagacttcggttctaggacttcaaaaagtttagaaacttttaggctagtttctttatttaccagccttctagacgtgagctcattacctgaccttttagagtcttggttttctcatctataaaatgaatgatgatagtagctttctcattgcatttttgggagtattaaatgatacatgttaagtgcttaacacattgcctagtatattgtgggtaataaagatttattttactaatgattactgctacaaattagtagctaccattgatagctattacttcttcctttcttggttttccatctgtcggcttcctcttgttttcctccaatatcacagacacagttgcttagtcttgtatgtgtttcttcagctctctgcatatttgttaccggaatgtctcagaatgttgcctgtaggcctcatcttttttttttttttcccctttactccctccatatacattctcatccacaatcaagacttcagcatgttcttgtatgctgatgagttccacatggtcatttccaactgaagtctcttttttgggctcatctgaaaggcatttcttatcctgctacatgacactttaggggacccagtgggcataagggcaagtaagcatcaatttgggaatgaatactattgatctggcactaacttttattggttgattggtaagaatttgcagaaatctaaagtttaattaaaattttgttttatactttgtgttttaaaatctgatgttgcatatcacactgtaatacaaatgcattcagtaaagtgtgccctttctacaactcttgattttaatgtagttactggaattatttgtttggaaaaacctggctttctgaatagctgaaattttacgcatttcagcaataatggtgtccttaagatcgacatctttccggattcattttttgtattgatttaattcaacaatcatttgtgcaacagtaacttgcttacaatgccttctcaggcactaacttgctatattaaaatagaatttattaactgaccattccttaatgacttagccattttttgtgtgttttttttaattgtcagatgtatgccacataaagaaaagtattaaaaatgtgtagtatggtgtaaagaatagcaaagttgagctccaaactacccaacttcaggttaacaacattgccagtgtcttagaagccccatgtgttcctctctcattgtttccgtctctctcagcctcagaggtaaacacgtcaggtttgctagctcttctttatggactaaccaccccattgttgttttgcataaagcagtgtattgttgttttaaaaatggagtaacttgtatacccatcgctgtgtaagggcacggcagtgttgccactgcaggctactataagaagagaaacggagctgagtctgggtcatagccgggcctgtttttccctggagtttaccaaagccccttctgtggaagttagtggccaagggcaagaatgggtcctgggaaacacagggcttagcatagtccgaacaactaacagggctgttttgagggtcatgtgtcacatgtctgacagaagtatgtttgtaagttcactatgagtagatcaaagtgggccattatagggtgaaaggaatgtcctcagctgatagtgacatcaaggcagggctgggaattgacggagatagagtgggaactccattaacaggtgattaggacaagtagccataggagtcctggtcaggctcactggggtgtcttgtcttcaggttaaaaaggtggttgggtgggtgagtggggtttagggggggtctggtgacagccctcaacttgtctatcgagtcacattgccgaaatgtgggcctattctctctatatctgttgtttagctctgatcctgtgatcacatttctctgtgttttgaggattccatttgcttcttatttgtactgagtctcctttcttatatcccctattttctccttcttggactactcttgtgttagtggaacatgtcatctggtatcttaaaacgtcatgagaaatgcattctttgagatcttgtaaattcaaaaatgtagacattttttctaccctctttcttagatttactgggtagagaattcttggtgggaaataattttcctcacttatttgaaagtattgctccattgacttcttgcttccagtgttgctgttgagaagttaagagtcattctgctttctcattattcttatgtgatcttgctgtttttctctgattatttgtaagaatttctgttttctccagtgttttgaaatttcacaatgatacagctaattgtagatctcattttcctttgtgctcggtactcagtggattctttaaacttggaaacaaatttcttttatttctaagaaggcttctagagtcatttcattaatgacttcatcctttaattttttcctctcctttctttctaagactcctgtttggaagttttgcctcctatactagtcctctgtttttcatgttttttttcattttttattttttgacattttactttctgggagatttcattttccaactgatattattttcttctatcatgttaattattaagaattctttttcttcttgcagcatcctattcttatttaatagatgaagcattttttaatatctgataattttaatgatagattttttgaagttttctctgcatactttcttctttattactgttttgatttctaacttctctgttaaaggcttttcttagatgactgttcattgtatatgtgcttataatgcaaagtggcagactaaaacattgaaagtcttgagcatgcagattaaagatctgggcatattatttcattgcagggtgatctgcttgagctcttttcttggggtaacttttgtcagtatcttttcttagtatctttagagaattcctcttggactgattagattccttagggaagactccttcagttttctgcttggctattaactgtttttactattcttccctctgttttctccaacttgctctttccaacttgctatgggctagggaatcaggaaaaagaaaaaaaaaaactgatcaggacagtttcaaagtagaacagttaggttccgagtgacagcctaagggattggcctgtgcgtaaaatgctttaatgtgtggaatttatgacattgattttgatgacccaggagcatgtttttatttcgtgctcctgattatattgtggaaaggtgatttagtcatacaacagaattctaagtagatgaagtattaatgcaaactgttatagagtatttgtttttcttaatccatttcatttgatccactgtgtgtacttttccagttgattataaattgatttgttcattaatttgttctagttactggtccataattatcataatgtttttattttttgttgaagtatgtgcagtattttggactttttccagttatgatggactatcagtatgttctcacaagtaatgggacactgtattttacaaatatttattactcttgatgttctctaagattctgtattatgagctcttgttgatttacagacatttggaaatgtaactatttgattcttattcttggttaatgttttatcctcctagaccaaaggtgtttattctttagaactttatatgtttgttttaacagctggatttctagtgataggcaaacttttaacaaaaattccaattacatataagcttactgccatttgatttctataattaaaaatattaatattattagtggggtttagtcagtcactatattagacaaacgtgtgagttagaaattcaggtgtacacaaggattattaattggggcttcttcaaagaattttgacattagtaaaatttttcttttttttcaaaatgtttcaaagatttttttttaattaattaattaatttatttttagacaaagtcttgcttaaagtcttgctcttggccaccaggctggagtgcagtggcagaatctcggctcactgcaacctctgcctcctgggttcaagctattctcttgcctcagcctcccgagtaggtgggattacaggtgcctaccaccatgcctggctaatttttgtattttttgtagagatggggtttccctatgttggccaggctgatcttgaactcctgacctcaggtgatccaccgccttggcctcccaaagtgctgggattacaggcgtgaaccgccattcccagccaggatgatttatttttaatagcacccctaatgtatttaaagcatgattgcacatacaaaatttggatttacatacattttcagaactacccgttttgtgtaagtatacacttatattttttaattttaaaaatattaaaattttgacaattttatgtgttattggggtaccgtttggtattttgctatgtgtttacaatgtggaatgagtatatcaggctaattaacaacacatttcttacacgtgagagggctgttttttagaaatcagcttcagcttttgattttctgaatgaccttgagcaaattgttttcttgttctgtaacatacttttcttggccataaaattgagatgaagatgttaatgctgatctaaccaaatgattttgatattatagggattaatgaactgtttgtaaaatattttgttgttcttggaattacttacactggtgatgttattaatattatgtactatgttcacagtggactaatgatgccattgtattagctaatgttttagattacttttaattaaaattgtatggagacattggtgtgcttgctgcaatcttgtcctcctctgcaaatggcaagggagtattatcacaaaatatttaaattatacataaattcaaggtttttaagaatttgtcaactccctggaagaagaagaagtaagaaattactcattaagactcaggaatctcagcatccctatttggaagaattggattatttggcttatttataaatttcaaaatgatacattttcagctaatgatgattgaatcttgtcagacaccttacacaactgtgaacattccacaagttaagaaaacaacttcaggtggggtgtggtggctcatgcccataatctcaacaagttttgaggccaagcaggaggattgcttgagcccaggagtttgagaccagccgggcaatatagtgagaaccttcctctataaaaagttaaaaaattagccagttgtgatggtgttacttatagtcctagctactcagtaggctgaggtgggaggaacactagagaccaggggtttgaggctgcagtacgctatgaccatgccactgcactccagcctgggtgatagagccagaccttcatatcttaaaaaaacaaaacaaaatgcatttatagtaccattaataagaatgatatacttaagagtaaactttaaaaagttcaagactagtacactgaaaattttaaaatattgttaaatcgaagatgtaagtaaatggaaaggcgtgatgtgtttatggattggaagacttaataatgttaaaatatgtagataaaggcaaggcatggtggctcatgcccgtaatcctagcactttgggaggccgaggtgggcggatcacgaggtcaggagtttgagaccaacttgaccaacatggtgaaaccctgtctctactaaaaatacaaaaattagccgggcatggtggcacgtgcctgtagtctcagctactcgggaggctgaggcaggagaattgcttgaacccgggaggcagaggttgtagtgagccaagatcgcgccattgcactccagcctgggcaacagagcgagactccttctcaaaaaaaaaccaaaaaaattatatatatatatatgtgtgtgtgtgtgtgtgtgtgtgtgtgtgtagataaaacacaattcatatcaaaatcccagctggatgctgctgttgttgtcgttgttgttgttgttgttgttgttgttgcagaatttgaccagctgatcttaaaaccacacagtgataatacaagggacccagaatggccaaacagtattgaaaaagaagatcaaagttggaggactcatattttccaatttcaaacttactttaaagctactataatcaagatgctgtggtactggcataaagaaagacatatatgttggtggaatagaattgagaatctagaaatctttacatttaatagtcaattgattttccagaagaatgctattaagacggttaaactgggtaagaatagtcttgtcagcaaattgtgctgggacaactggatatctacaagaaaagaatgtttagatccctacctcacagcatatgcagaaattaactcaaagtgcattatagctaaaactatgaaactctcagaggaaaacattggagtaaatcttcattaccttgggttaggcagttgtttcttagacattacactaaaagcacaaacaacagaaggaaaaaaaaaaaaccatacttggctggtgggggatgtaaaatggtgcaaccactttggaaaacagcctggcagttcctgaaaatgttaaaatacaattaatatatgacctagcaattctactcctagttatgtacccaagaaaaatgaaaacataaatccctgcaaaaactagtttccaaatgtaatggagataggcagtcagtaaacaaaatatataaaatgcccagtggtgatacaactcctgatgtttcatttcattctttttctatatggtaagcccccttgactattagaaaaattgtacttaaaaaatatagcttgtacatacttcgtcagaataaagtaggaatgttacttttttcataatctcttttaggtcaattgaatattttaaaatatatctgtttttgttttgctaattaaacctatttttttttgatctagggtttacaatacacatctgtaatttattgttcaactgactgagactgggtttcactctgtcacccagtttagagtgcagttgcatgatgagaggtaactgcagcctcaaaccccttggctcaaggaatccaatcctcctgcctctgcctcccaagtagctaggactacaggtgcatgccacatctggccagtttttgaaatctttttgcagggatggggtctcactctgttgcttcagctggtctcaaactcctaggctcaagcaaacctcccacctaggcctcccatagtgctatggtgataggcatgagccactgcacttggcttattgtttatcttaatatatctcttcacataaaatatagtatgcttaaaatagtatatagttggcccttgaaaacatgggtttgaattgcatgggtccacttgtatgctgatttttttcaataaataaactcggccctctatgtctgtgaattctgcatccacaaccaaaagtggctcaaaaatacagtattcctgggatgcaaaacctgtagatgtggagaactgaccttttgagtatgcacattctgcagggacaactgcaggacttgagtatgcttggatttagtagccatgggaggtcctggaaccaatcccctttgaataccaagggaagactgttgcttttatttcttccttcctgccccttgtgcaattactgttatgcattttatatttatttttatgtttgttataagctctacaatacatttttatttttgctttttactgtcagttttctcttaaatttaaaaataagaaaaaaattcatttgtagacacccacatttaccattcatcatattctttatttctttttgtagatgcaagttttcatctgacaacactttctctttgccaaaagaacttcttgtagcttttcttgcagttcacatcttctgacaactagttctctcagattttgtttgcttgaaaaaaattttggtactatttttgaatgacattttcattgtatgtaggattccagggtgatagttttatttattttttcctgaactttgaagatgttcttctattgtcttctggcttatattgtgtctgatgaaaagtcagtaatcactcttacctattccctgtgtaagttgtattttttccctttgtttgcttctatttatcactagttatcaggaattttctttgttattattctcttttgggtttcgtcttttaaatatatggtttcatgctttcataaaatataatttgccaaatttttaacattgtattttcaaatgctttactctcttgactctgatgactctgatgtactttgatgacatgcatattatattatcatattatattgtttgctgttttccctttttactgagagtgtttatttcttacagtcttcctccccctgctccccaaccttcagtttatgtagctgctcttgtgttgtattcagattcactgatcttttcttctcctatatttatatgcatttaactatatccagggagtattccagttcaggtgttgtatttttcaactccagatgtttgattttttcctatactttatttaaatacattacatgtcttgtttttttttttaaataaacacacacatttattcatttgaattccttccttattaattccatcatctctatcattgctatatctgtttatatagtctaatttttctcttggttaagggctgcattttcctttagagggtatttgtttttatttttgtgggaagctaccttacaagtatgtcaacttagtctcttcaagccggggttttgagttttgtttggtgggtgaactgtgtattatcatatggtttgtttagccctaatcccggtacctggtcttctagggtgtctgctgaatgccctaggtgtttactgaagttccagtgggactctaatgtcttcaacactgtgtgtacttcagcatttacccagcttagttctctctagtagttgtcgttttttgtgttgtctcttgaaatctcaccctacacatgtgcagcgtagtattcagacaaaaaccaaggggacctgtatgcggatttctggacctctttctttgtagaactccttctgtttttgtattctcccttcaaattgctctgatctctgtgttgtcatgtaacaagaccattgtgcttttttggggtagccagtacctacagcatggtgcagtaaatgctcggaataatagtctagtgtcaggaaaccattgtttcccatattctgctttctggttgttgactgcaggaaggactgatctagtgctagttactccacagtggctgacagtcccctctgtattattatttaacctgttattttatagtccattaatgcagaaatgtttccatccttgctgtactctcatgtccacaacaaagcctgacacattctaagtggttagtagccatttactgagtgctgtatgcagtagattatctctccctttctcctgcatggtcaaatttttccttcagtgcgggactccctccaattagcattggaatatgtgttagtctccctttgtcttaaaccgccatatctggacctgcccttatctaattcccaacctgcttcagtgttgctttcatccagcagttccattgcaataatattcacaagtgttattgatgactcccctatggtttaaacctatctcggtcttaatctcacttgattcctggtggcatttgacactgctgactgtcctggaatcctcttttcccttactttcctgaccccatattttctacttattttccttctggctgtccctttgtctgtctggcttctgtttctctgaccaggcataaactgctactgatagtcagggtgttgtccattgtccttgttgttctacaaactgttgccttgtaatctcgtaattaccatccagaagctggtgttttctgaatatttttttttctggtttcagattcatgtggacagttggctgttgacttctctgtccctgaagctctcaaaagtatgccccaaattaagctaatcattactctttcctctctgacatcatcattcttcttcttcttcttctttttttttttttttttgagacagaatcttgccctgttgccctggctggagtgcagtggtgtgtgatcttggctcactgtaacctctacctcctcggttcaaacaattctcctgcctcagcctcctgagtagctgggattacagctgcccgccaccatgcctgactaattgttgtatttttagtagagatggggttttaccatgttggccaggctggtctcgaactcctgacctcaaatgatatacccgcctgggcctcccaaagtgttgggattacaggtgtgagccaccccgcccagccttacatcatcattcttgagattgcaatttagatagctctaatttcaagagacctttcctgattcttcaaagtgttctgtaccttttccatcttgacacttcgaaccctagtattgaaattgccttgtagtgcattggcattgccccaaacctgtttatttccctcactaggcgtgaaattctttgaaggcaggaatggctgctatcagtaggtgctcaataagtatttggggatggataaatgaaggaatgaatgatattataggaagtgagtattttattcagtgcaggatttagtttgtttttctgctcttaaaggataaacatatctgcactgttttaatagaatgttctagtaatatctgtggcagtgatggtgggtcatagcaggcaggcagcagttgtgaactcagcatatcagggcagcctaaggaaggtggggtgtgtgtgtgtgtgtgcgtgtgtgtgtgtgtatgtatgtacatgcgtgtgatactcagacacacagacatccatccatcttaaggtgtcagaatattaagtaagattaagttgtgttagacaatggagtcttacacagtgacttgacccccaggataccacttctgttacagatgcttggggaggggtcctctggtttttctgtttgtgctggatttctaatattcatgataggagcttctcaacctaatcctggagccggagctgcttgggtttgaatcccagctctgccaacatgtgacctcaggcaaataccgttacttttctgtgtgtgtttcctcagttgtaagacagggtaatgataatacacaccttcttagaggtaatgtctgtaaagcaattaaagggtgcctggcacgtgataattgctatgtaggggcttattaaatacaaccacaatgtttggggccgttgtgttacctccattttacagttcccaaagtgagacccaaatagctgagtgttacgaagtgtccctccagtagcagagctggtctgtctgtctctgggcccctcttcctcaactgtgcttacctgcatcttcactcaacacttaacctctgtttaatgtcacagggcaggctcagagagcagcagccagacatgggtgttttctaccttcggccctgcagaggatttctgtaagaaaagcagcatgacagagagagccccccaggacatacagaaaatgagtacttagagtctaaattatagagaatggaatgttaagtcagtggttctcagttcagactgcacgttagaatcacctagtgggcttttaaaatatacagatgccagggcttcaccccagactcattaaatgaaggtctccgagtcatgaataacatcggtgggtgggggccaaggactttccagagctccccaggtagttcagatatgcagccatggttgacaaccattgacttagaactgggagggggctcccttattctcttgttcctccagtgtttcctaagcgtcgaccttatcaaaagtaggtctgacagtgtgttcccagtgcctggacctggatattttttacttcagctttaattcaaaccattatgtgctgctagtcactgtggtgtgggagcagcagtgcacaaggtggtgaggaagccagcctgcctcaaggagtttaacatttcctaggaaagcagtgtctgaatacttagatgattctataactgacttgcacagacgttctgctgtcacagtaggtattactgaataatgtggctgctccaagttttttagttatgttccatgtagttgtgagtcactgccaaggcactcggtcttctaaagggtctctgaaaaatcactgacgtgaggcggattaataggcaaaaaggcatgggatttatttaatgtttgtacatgggagccctcagaatgaagacccaaaccccaaatgaggaacagaaacttctgtgcacttttgaggttacagaaagaatacaggctcagagaatggcccaagacaggttttagtggcaagacaagtaatgggagggaagaaggggggaggcttggctagcaaaggtggtcttattatacagatgaaacctcagagatagcagttctcagagagaacagatgatagatgtttcttttcagacgtttaaaggctgcagactctcagtctctcctacatccaagacaggcctggatacgttcatggagattctctgtagatgtaaattaccccaacaaaagatggcattccagaggtgtttctgtctgctggccctgcagccgccatttcaaaatatgtcaaattaaaatattttgatttccttccgtgggaagccatcagaacaagaagagatgagatcaaacagcaaagaattgccctggctgctgtcttgaagagtgtagggggacgagggtgaaaatggaggctgtcacagcagactagacaaatggtgacagtggcttgggccagggtggcaggggcatctttgagagtagagccagcaggattaggattccacggtctgagaaaggaaccaaggacgactccatgttacacttgtttctgctcaccatagtctgtgttaataggtgatttagaatttcatattttccttcttgggtacttacaagataatttagtacttctgaaaacttttctatagttagattatttttgctttctttttagatgcagaataatatctacctatttacgtgtgttgagattttgcatttgatttcagtgctaaagattttagataaagctccaattcaaaaataacctgaattcttggaagtttaaattacttaaagttcaataagttgattatttaggtcattttacttactttagtgctttacattaaaattttcctgtttaatgaacatttaactaattaggaaaatttattagtcaaattgtcagactctgttaaatggcttgtcaaaatgtttgtttagcagttattcctgtcttcttaacattgttgatctttctaaccctctagttcagttttttctgggtgattgtgttaagtggtagtatttaccaattattttaaaaatcctttattatgaaaataagtcactgtggacagttaaagcataaaaagtttaaagaagcaaaaaataagcatacaaaatcaaccattattttaccattcttaggcagccactgttttttttgttttttgtttttttttaactttttagagcaattttaggttcacagcaaaattgagtagctggtacactgatatctcgtatgtctcctgcccctgcacgtgcacagcctcctccatgatcaccatcccccaccggagtggtatgttgcaaccattgatgagcctgtattgacaccaggatcacctgaagtccatactttacattagaattcactcttgatattgtacattctctgggtgtgggtgaatttatgaggtgtgtattcatcatcacagtttcctacagagtcctttcactgcccttaaaatcctctgacctctgcatagttatctcttccctctaacccctggcaaccacacgtcttttaactgtctctgtagttttgccttttgcagaatgtcgtatcattgggatcatacagaatatagacttttcagactgataactttcacatagtaatatttattgtttcctccctgtgttttcatagctcatttgtttgataactcacttgttttcagtgctgagtaatattccattgtgtggctatatcaaagtttatgtattcacctaatgaagaatatcttggttgcttccaagttttcgcaattatgaataaaactggcataaacatctgtgtgcaggtttttgtatgtggaaataagttttccatttctttgggtgaataccaaggagtgtggatcatatggtacgggtatgtttcgttttgtaagaagccaccaggctgtcctcagaagtgactgtaacattttacatccccagcagcaatgactgagaattcccattgctccgcatcctctttaccatttggtgttgtctggattttggccattctagtgatatgttgttgttgatgaagtatctattaaggtctttggctcattttttaattggttgtttgaagcaactacttttaaaggtattatttccttcctgtctttttatttttatgcttttttatgtgagtggttgagatttggggtaaatattccatctgttttttttccatttaacgtcacgatgaaatctttttctgttttgttaaagtgcattatgtcattgtaacaggtatgtaattataatgagatttgacattcacctattcttagaaattttggttctttctacctttgcaaaattataaacaatattgccattgagatgattgtgcctgaaaacctcccctgtgttttgtgttgttttcttagagcatatcctagaagctaagtgactggtttggagaacagagacatttttgagggtctttaaacatattatgagattactttccaatgtttatattaataaaaatactagcagctaacagttactgagctctatgtctgtgacagacactagatttagtctttcagatgtttttcagttctcccagcaccactgtgggtggacttaggacagttcttgttttatgggtggagaaactgaagcctagaaagatggtaaaagtggccaataagagacagtaataatgacagagtcgaataaagagatatgctatatagaggaagactattttttaaatttcggttattctcaagttgatttacagtgttaacagagttccaaacaaaatcccttaattaaggtaaaatatagacgttaatatttatcaactttttggatgatgtttttaaatttcagtgcaatagaagaaatcatataagacacaaagaagaattaagactgatgtggccaacagatgaaggaatggcaaacaatataaagaaaatatccatatttaaattgttttaaattattagtgggcatttttattctatacagttcgtaatagttttaaaataatttcaacttttattttagattaaaggtatacatgtgcaaatttgttatgtgggtctgttgcgtgatcctgaggtttagggtacagatgagcccatcacccaggtagtgagtgtggtgcccagcaggttttataacttttcagtctagtcccacccacccttagtagtccccagtgtctgttgttcacatctttatatccatgtgtactcagtatctagctctcatttatacgtaaggatatgtggtatttgtttttctgttcttgcattaatttgcctaggatagtggcctctagctgcagccatcttgctgcaaaagacaagattttattctcttttatggctgtgtaatattccatggtgtgttcctaccatgttctctttattcagtccaccattgataggcacctaggttgattccatgtctgtactgttgtgatggaaaatattcatatttcagaagtaaggaaagaagagagggacgacaagacaggttatcagtgtttcagagcaaatgtctttagactgcctgtctcatggagtttgtatgtttttactctaaatctccagtctgatttttgtgtataggagatttacaatggacatttctgcattttagaagtagactatgttgtacagtctcctgttatttcttgggtgtgtctttatgtgtgaatttgtgttttctgttgatgaaacaagaaaaaatatatacttaaaacacccaaatatatctgtagataatttacatatcagttgatgaactattactgtttttgatagaaaatccatgtggcttaagcaagggaaaggtttgtttctctcttaaatgtagagaggtagatagtccagggttggtttggcggtcccacagccattaggacttgggcgtctttgtcagtcactgctcgccattcacctcgtgtgtctcgtcactgtcctaggtcagtgctctagtctgactatgatgcatttcagcatgcacgaaggaggagagtagtagatgaaaatgggcaggagtggaagggagcatatgcttagctgtcatttaaggaggtttctgaatattgccaagtagtacttagaccccgtctccttgaccagaactgtaggtacgtggaacaaggtacattgttttatgcccagctgaaaatcaggatttgtattactaaagagaaatgagagaatggatattgggcagtgtaacaatctttgccccatcacgcgtgcatgcgtgcatgcgtgcgctctctctctctttctctctttcactcatttaagtgtgacaagagcaaaagaaacatttctaatacaaatcagaacaataatcacttgggcccttttctctgctgaatgtaaagttttcataatgaggcattattaggcttggagggtgcctttggcactagagttcccttgacatcatccaagatattctgcgggtagaaggagcaggtgagagaagcggggaggctggtcttggtggggaggagacaagacctggaggtgcagtcaattctcattctgctgttttgagcaaccttctgaagaagagcagggctgtgcaactgaatactgactctgagcccattgtgaccctgctgagagaacacctctaggaggaaagagttctgtattttagaaaaagaagaaaattcgttcttcttttgttgtgtctatattaaattcagaaagaagtaaggctgaccagcaagacttgggagggcacaaattacatccttctgaattgctaagcacaggtccatgtgataggcacttagtaattactttaatgacagtgatgagatggtgctaaaactatcataatttctaactctgtaacttcatgaatgattttatttaaaaacacacactgtcctttttaatttatgcttacagttgtatttgtgatcaaatcaagtgttctctataatctagaatgtactcttaaaatagtagacttctcttatgctccaaaatttaaaactgaaggaacaagtaactttcgtgttttagtatttggaagtcatttcagaatcatataaggaggttagccaaagagaaatgttgatgtaaattttgctttgtacattttgtgccatttttcaactcgattttactgctgaaattacacatgcattatttaaaaatcccagtggtacagtctcaaagacataaatcaccttattttgatcagtttttgaagattgaaacaaaactaatgaaaaatattcttcactaatgaaaaatattcttcactatgtggaagagatttagctgaaatttttcgtttttgacctttgaaaatgttcatgtagtataattagggctttctgcacatgtcatttctttgctaattgttttatacttatagttcatcagatgagagctaaagtgttaaatcttcaatgcatgaagttgaaaatgtaagaaaattgtagaactcacctttgttcctgttctttaattcagaagatattttctttttttttttttggtatactcaaaaatatacatttgcatgtatataaacatatatacatgcacatacatttacacacctatataatgtataacatatagaggttatatattatgtgatatatacatagtatgtataccatcaatttataatacacatatatactatgtttacttatacatgcagctgtagatcataggatacacagacaaaccccaggaatggcagctacctatgtcataccatcctgctgggtgatgcttttcatattcttttaaccaacaactaacttttataatttgaattactttgtcacaggctaattattgaaagtataggtaatttttaggtgttctacttaaagagctattttttactgagtgtattttaaaaaattattatgaaatcttttatgaaactattctcctgattactaaatgaaatatttttagagcttccatgacctcttaaggaattcattttctggtgtgctactaacagtattttcacaaaatgctttaagcatacattaattaggttgtaatagtcttttggatgaattatgtgtttgtataaatgataatttggaaaagttcatggaagtctgatgtgaagaactctattgtttgacaacagtttgaaagatactgagtattagacatttttactttaaaagaaatggagacaaaatcattcaaaggaacgcactcacttaagaattcattaactgtaatagactttatcacccattatttggggacatgaaaaagtgctcatttcaagggtattaagtgccatgttgggtcagatctgcctgctgttctcagatgttgataaccagatactttatctttttggtgaggtgatgagtgtgtgtgccttttattgtgttatctcagaagattagggttataagcaaacattcctgatttttctctgtagtctgtattttatacattattcataaatgtatgaaaatcattactgaacctagttacatttttagtctgaaccatttctggaaggaatttcctaagctttctgaaaaaagtagcagcatgtggtgtgataggaagctgtattattaggtttataagagtgcccagtaattcacgcatgttcatcattatgtaaaaatttcagttattccctatttattattcattttgtagagcactaatgtttaatctgttttcatgttgaatgcatatcctcttaattattttagctgatttttgtctagtgtacttcatttcctcttgagctatacctttgtaaattctgtagagtattagagagagagatgcatcatggttctacagaacagaaactcaagtagtgttttgtgtttttactcctcttcctggcaatactcaacacttttgcttgcttcctgcaggaatgtattgacctgttgcattaggaaatagcccacaacgacttagggagccaggcacatatcacttttcatgacttgcagctcagagcctgtcccgcctagagtaaggtggaggtataattttggatgtgttgctgcaggttgtccatgttgatgcccaccattgttctgctaaggctttcagctgttctgtgttgtatcatctgttcgccttgaattgtattgccactagtgcttcctttttccagcacaggtaaagaattgcctgtgcatttcctctcctaggtcatcattacataagaccattttaatacctcacactatagttaaaattgctctttctggaaaacaaattcctttttattatggtatctttagcccattctcagtgactaagtcttttttctcagtttaatggtaattcatttgaagttttttgtgtttgtttttgtgacttctctctctttagtggagaagcttaccagaagtacttaaagagccaattaagttacagttttaggcccttattttgtcaaagcatttatttttcaaagtgttttagtaagatatttatagtttttatgtttgtttcccctagaagataagatgagcttatatagcatacccagtttgagtatgaggcaggaaaatacattgtttagaggtgaataatttattttgtactattctttctgcagataaaattagtaatatgtattaaaaattttaaagcatgagccttttctcttcaggacattgatctgggaaataattttatgaataatatctcaaaaacacaggcaacaaaagtaaaaataaatgggattatttcaaactcaaaagcttctgcacagcaaaggaaacaacagaatgaaaagacaacctacagaatgggagaacatatttgcaaactgttcatctcaaagggaactaatatccagaatgtactaggaacttaaacatctgaacagaaaaaaaaaagaaagattaaaaaatgagcaaatgatctgaacacacatttctcaaaataatacatatacatgagcaacaaatatatgaaaagtatgctcaacatcactaatcagggaaatgcaaataaaaaaccacaataagatatcatctcatcccagataggatggccattattaaaaagacaaaaaaaaacatgctggcaatgatacggagaaaagggaactcttacacactatgcaggaaagtaaactagtatggtcactatggagagcagagtggaagctcctccagcaatcccactactgggcatttatccagaggaaaggaaatcagtttatcaaagagatacctgcacttctgtgtttattgtagcactgttcacaatatacaagatatggaagtaacccatgtccaacaacagatgaatggataaaaaatgtgctatatatatgcaatggaatacgctattcagccataaaaaaaaaaaggaagtcctgtcatttgagacaacagggatggaactggagggcattatgtttcttgaaataagccaggaacagaaagttaaacaccacatatgttctcatatgcagaagctaaaaagaagttgatttcatagaagtcaaaagtagaacagagaataggagggttgaaggaagagtgggggatagggagagagttgttaaaggatatgaaactccagctagataggaagaatcagttcaagtcttccatagcactgtagggtggctatcattaacaatgattatggtttaaatatgtaggagggtattgactgttcccaacacaaagaagtgataaatgtttgagatgatgaattatgctaattacccattactatatattgtaatgtatcaaaacattactgtgtaccccatacatatatatgattattatgtgtcaaataaaaataaaagtgtgagccttgctacccaacaattacacttttggggatttgttgtatgaaataagagtaacaacaataatagtcaacatttctgtattgcttgctatgttttgggcatgatttaaagcatttgacatacatgtacttacctaactcattgaaatcctgtgagtaggtactgttataccagttttataaagaaattgaggcagagaagattaagtgatttgtccagttttagtctgtctctgttacatccagagatacgcataaaaaatatgtagaggattagtaattttaaatccatttatatttccacaatagaggttatcattaaataagaggagactcatataatagaattctatgaggagataaaaacggcaagtctagccttctgtaatgctaaacttataagaagtataattctattttagtaaaaaggatgttagtatacatatattgaatgcaaatattgtgtgtataaactagaaagccatgcaagagaatattaatagtactgatgaactctggatattgggattaggagtgattttatttgtgcatatgtttttctattttacagtgctttttcattgagcacattctgcatttgggaaagaaaggttatttaaagttgttcttattaaagttactgcatttaattctgtttttgccattgtgtcaggcaagtaaaaatgctagatatcaagttaccagaatcttctctggagcccttcctctgggggttacatgtatatgctgcctgtcttttggaatagtgatttgtaagtgacatggtttaagggtttggaccaacaggttcatagtttcaccctgctttcttttagagctgctggataaattctgtccggtttcaatgatttatctatatttaggttgtcaacctaggtaagaacatcctgtgcagctctctgtttgctctattgagtccttgtatggttatcttgttagtatagtgctaatgataacaggctgtgtgtaaaagctctctgtacacagctgtcgaactctgctgtgtttggtggtgcagactacaccctgaatcctgttaaagaaaacctttgagatcataacaggatgtttggaagttttaatataaatctcttacttatatcaaaagcagttgaagcaaatagtcttaaaatatagtagaattctaatgtatctgacctgcttccttaagaattcagtttggctatggtaatctctgcaatcttctccttaaataaaaactgaaacattaagtctgccccttttctttaatccctgttcaagagggtatgtcgatacttgaacccttttaccagcatttaaagaaccagctgctgctggcatagcatgtctgagattgcattttgtcctgcctacctttttattagaccttgcacagccatatttgtgagtggattagtttcctgtttttgccataataaattaccacaaattgaccagtttaaaacaacactcatttatcatttcccagttttgtaggtcataagtctaggtaaggtatggctgcactaagcctctgccctctcacaaggccaaaatcaaggtgctggtagggctgtctatgttcctttctggaatctctgaggatgagtcttcttccaaacttactagaattgcctgagttcagtttctttgattgtcggatggaagcctccatcttctgccagctcttggccaggggctggtctttgcccatgaggctgctcacatcccttcgtgttttccatgtgaccctgtccagcaagagcagcttgagagccattcaagggaatcttttacttcccttctgctacatctttctgctttaagagatcatgtgattagattggggccagccaagtaatccagagtaagctccctactacatttgaaagtaccttttgctttgtaaagtaacagattcatgggttccagggatccggaacatggacatcttttgggggccactctgcctaccacagtgagcctgttctcatgtatacaaacatactctttctatctgtttagcactacagtggatacccagaccataagcgtcatagtcctgacacacgagttggtaaaaaactaactgggaacttgtgataagcacttatgttagtgttttaggagtttaaaggaaagaaaaattagtgaagatggaaaatagcaaaggccttatagaggaggaagcacgtgaatttcgcccttgaagactactgtggattcgatagtctaatgattgaggagttacagaagtgggggaagaacttgatcaacttgaacaaataggatgtaggattgggcctgatgtgtttaatgtgatagcagagaggcgatattaattaggaggaagtagtaaggaataaaatatacagttgtacaaggtttggagaggcatgcagtggaatttcaatttgaattcctgaaaagggattttagttcaccaagatttgagcgagatagtaatataggaaataagtgtttcataaagatgagtctgggagtgatctgcaggacagagagaaggtggagaagatggagttagccaggtgagcatacgatatggggtttgggccaccacaatcaggcatcttcttatttagatcatcttaaatcttgacttcataggattgttaccatttcaaaacataggctttaagtgactacttcattaactccttcattcaccttactatctttggttttattgtatacaataacttttttttttgaggccctggtgttaatcagaatgatgcatctttctcctctgtcaggctttcagtgcttcacatacttttcagatagtcttcagaactccttcaggacagagagaactgcttttcctatatgaatatagagagagctaaaaattcagaaatttgaagtgattatatgaggatcacccagcatgtcagtgtctccagtagaagtgaaattccagtctttaattcggagacaatgcccaatcactgtggctactcttagaaacaatttaagagaatcttcagacccacagcttaaaataactcacgtacatggcataaaataaatacttgggagttccttggatgcagggtgtttgtcttgattatcttgggtgccccttcagcttattatgggtcctggctcatagaaggagccctgatatgtttattaaatcagggattgatgattgggaccacctgggctgacctttgaacgacttcttacttcctatagtcttcaaaactgccagaggctggggggatagttgacaaaccgggggacgtgctatcctaatctgcagaggtgctatcctaaatcactgaccaattccagctttaaggttcacagaaccttttgaaaaacatgatctggttttaaaattgtttccgtgttgatccattttgatggggggtgaggttcgctattcacatcagtgagtatggccagcctttgtctgcggagatctgattagtttgttaaattcaaagtagcattttagacatgatttcagtaaaggttaggggcactctttggctcttaaattttaatagttttataaaaaccctcttcaagacaaagttgtaatttaatacaaaatcgtaaattggtaaacctgtaacatttgtatcatgaaacaggtgatgtaactgaagattaaataaatgtaaaaaatttagatattgcttttgaattggaaatggcaatatttgtatatttttgacaaagcttgaaggagcaaaatctcatgataaacactatatgcaattgacctgaatgatgtaatgttaaagagccactgcagaagcatttgcaaatcataaattaaagagctctttctcaattaacagttacagatgtcttctcagtgcagggaagtgtgctagggactgcatcctagagatacagtctgtgctggcatagggcttctaacctagtggaggtgacacagatacaggatgtagtttccaaagtagtctaccacgggtccagcgagagcatgcaaacattattaacacagggtaagttaccactgagtgctagattagtggattaaaatgacctttctacccctctctgcctggtgaacggctgctaatctttcaatgttagctaaagctcctaagactcctgtagacggtctttttcgaccccatacagcctttattctctgcggtactcaatgtgcgctgctttccaagcatttgtgatacctcaatgggcatagtctaccagaatgagtgcaggatggggaagtctgggactcccagcctcccagagcacaagaaaaacttgtaactgtcagaaatcagaattaatcgattaataatagcaaatattaagtaacaaatattaaggttaattttttaaatattctaccagccaatttagtctctttgttctaatttcatcttcaccaagcagtcttatggttgtacatttggttttctacccccttatgtggcaaaaatattgctgtgattgtggttatagcccctgctgtcagcttgagacttgatgtctgtacattctcctttgagtctggatccttgatcctggcctgtgattccatctcaggagttagaagcctgtggtgcctggcctgagtcagctcattagcttcattgacaacattggttcgttcaacaaatattgcctgagaagaagacatttaagcaaagacctgcaggaaggaagggagttaactaagtggatatgtggggcaagaacttcccagaatgaagaaacacccgcattaattgcttgaggtatgagaggtgaggtcaggggcaccagtttgtatagggctttctaaaacattatttggagtcagatgacaagctatagaggatgctgagtcaaggtggaaacaacaaaatcctacttaggttttaacaaaattactgtggttgcggtgttgagaatagtgagatggtggcaaggatggaagcggggagatcaattagggggctgtttaaatgatccaaacaaaagataatgaggtaattggatcaggtgatagcagtacagatggcaggaagtataggattggggaatatattttaaaggctatgccaaacaggccttactgacagatgggttatggagtgtgtgtgtgtatgtgcgcgctcatgtacacttgtacatgtacctgtaaataaaggagagaaagaacagacaaaggataaccccaacgtttttagttgagaaattgtgttttcacacacactgagatggggaaactgagagcagcatgtttgatagtcaacgttaggagctcacctttagacatgttcactttgagaagtctgttaggtagccagaaggaactgttgcacaggcatttcgatgtacaaatctggagttatactctgtagaggtccagattagaaaaaaaattggagggtcatcaatctaacaaaaggtttaaaaactgtgggaatgtactgggtgcagtgagtcacatctgtaatcccagcagaaatgaagatcatgctgtaagagagtgggattacaattgacctccccatgtctcaggttccacatgcacagattcaaccaattgtggatcagaaataggtggaaaaaaaccaatacaacaatagaaataatacaagtaaaaaaatataactatttacgtagcatttacactgtattaggtactataagtaacccagtgatgattggaagtgtacaggaggatgtgcatgggttatttgtaaatactatgccatttcctatctgggacttgagcatctgaggttttgggtattcttggtgggccctggaaccaatgcccgtggatcccaagggatgactgtatgcctgtacgtgatgatgggcctctctccatgaatttaagtcaccaggactgggtttggggagtgtcagctcattttctgcctgtttatcagcagacacagatggggtagttttctcacttgcacctacggaaaatcctccttgctcctggggttgtttgactcagtgtctcccttttcttgtgtctgggaggttgatggcatagtacatttactccccaagtagtctgtgagtgtggttggttaaggtggctgaactgaactcggcatctcccagcaccaccaacctggaaagtgtttttggtaggtgctgtgtgtacaacatccttctgattgcaaaggcctgtactctagcattaggtcgggttaattcctgtcaggtcttttttttctcttagagccccatttctaatgaagggattaatttggcaggtgatatcaacttgcaagccaaatttagagttgattttccaaatgacttctcccaaatgccctattatttcctgtctccattgtaaaatatttcttcttcctggaattctctaactccctcttctttgagaaataaaaaaatatcaattttagtgtaataatttgtcttatttaattttgttacttaaatatcattcacattttaccaagcacttaaaatttggataggaatagagattgagataatatagctctactctcaggtaattcacattgtgggccaggcgccgtggctcacacctgtaatcttagcactttgggaggctgaggcaggtggaatcacctgaggtcgggagtttgagaccagcctaaccaacatgcagaaaccctgtctctactaaaaatacaaaattagcggggtgtgatggtgcatgccggtaatcccagctattcaggagctgaggcaggagaattgcttgaacccaggaggtggaggttgctgtgagccgagatcgcatcactgaactccagcctgggagacagagcgagactccgtcgcaaaaaaagaaaaaaaaaaatcacactgtgacctttataggatatctttttactgtccagttttacatataatttaccatggattttttaattaggatacctattttattgtaatctggcaatatttttcacatattggagataatttttgaagtcagttctttgtctatgatatattataacttccatttaataatcattggttttagattggaattgtgtcagctccctttctataacatatagtttccatgtataaagtaatctgagtatatatcttatgtgtgagtgtgtctctgaatttttttcattgcagatagtttggtggaattctatttttagttatgttttttctccatcactttgcttgggaacgctggatgaagtggttactttcatttctctttttcaccatcatgattgtttcctgcagtcccatttatttttgtcaagtttttcttcatgccatcaatctgtctcatttgtgtatctgttctgtttctttttcttttttcacagctgcgaagagccatggatggtcttttatttggttggttttcattcctgatgcatatacaaaccactagagtatgcatttttgaatcttatatatatcttccagatttagctttatattatgaagatatttgtcatttgggcagctgagaaaggctttttccttgagacactctctgcttaccttttataatgttcagacaggaggttgtcagttaacttgctataaatctaccttcagcttcagtgtgatataattatataagttctattattaatgatgcatttctggtttggtctgctcttgatagtgctagtggtcaccagccctgctattttggcatttatagtgagcacatatcttctgataattatatttctcttttataaaatgttttatatacacatttcttttaatgtgtcagcatagcaaatattttccaaatgtccacaacgtctgaggcattgttgtaagcaatgggaatgctatggtaaataagatgccatatacaaattacattctagtgtgggagagagacagcaagtaagaaagacacttgatagagctgcagagtgttgagtactgtgaagaacacgaagcgcgatgtgaacgtggagatgaaggcatgtgctgtggtcatggaaggccttttgggggaagtgactttcaagcagagacctgattgatatgatgccatgaagggcagtttagggaagggagcagcaagtcaagaggccctgaggctggagtgtctcagggccagcaagaaggtcagagtgcctggatgatagttggctagtgggtgagtggtaggagttgaggctggatcatagccagttagagggtgagtggtaggagatgaggttggatgatagtcagctagggggtgagtggtgggaggtgaggttggagggatagccggttagcaggtgagtggtgggaggtgaggctggatgatagccaactagggggtgagtggtaggaggtaaggttggatgatagctagggggtgagtagtggtaggtgaggttggatcatagccagctagagggtgaatgttaggaggtaaggttggatgatagtcagctagggggtgagtggtgggaggtgaggctggatgatagtcagctagagagtgaatggtaggaggtaaggttggatcatggccagctagggggtgaatggtaggaggtaaagttggatgatagctagcgggtgagtggtgggaggtgaggctgggtgtcagttagctaggggttgagtggtgggaagtaatgttggatgatagtcagctaggggttgagtggtgggaggtgaggttggatcatagccagctagggggtgaagggtaggaggtaaggttggatcatagccagctacggggtgaatggtaggaggtaaggttggatgacagtcagctagggggtgagtggtgggaggtgaggctgggtgtcagttagctagggggtgggtggtgggaggtaatgttggatgatattcagctagggggtgagtggtaggaggtgaggttggatcatagccagctagggggtgaatggtaggaggtaaggttggatgatcgtcagctgggggttgagtggtgggaggtgaggctgggtgtcagctagggggtgagtggtgggaggtgagcctggaaaggtagcagaagtgatccaggatcctaaggtgtgagaaagtgcttagattttattgattttcttttaggcataagagaaggccatggaggattttgagtagggttgggctgtaagcgtgtttgcatttatttacaaaaagattactctccttgctgtctggagaatcaaccataggattgcaagagagatcacgtaggagattctcataacaatctttgtaagtgatgaaggcagcttggattgtaggatcaccctgaaaatggtgagaagtggcagggcttgggttttattttgaaggcgtaatacacaggacttgataatggattagatctgcagaatgagggaaagaggtgaacctacattttgccctgagcaatggggtgaattgtgctatttatgaaaaagtggaagactcagagagagaggtaggtttggggctgaaaatgagccccatttgggctttttatgggctcttcctgatctccttctctccccttgcttttgaggtattaccagctacaggggctgaagaaggagcaatcaggccagggtttaaaggggcactgggactgagccagggaggtagctagcatgagtggtaagttgtttacatgcaggggattgaacaaataagtaaatatattgagggtaaagggaactaggtttatcatcaacagataagggatttataaatgtggaaaggggaaagattaaaaagaaccttgaggtgttagactagaattggaagtattaatgtaaacacatggttttggaaacatgtatatataggtgataatatagagacacactcatatacacacccagaaggcctaggagcagtcaatcacttatcagcagtgagtttgccaactgcctagattctggtttgtaaattccatcctctactaaaagggaagggaaccaaggctccttgaaggaatagttaattccaggataagtacaaaatgaccttggaaaactatctgtgctagaaagtaaggaaacactcagaatgatgggagcctttcaagttacaggtcccagcttgaagggactctcactggccaaattttggacaatttgagcaagagagtaaatgatggcgatggatatacattaaataaatgggagagaagcaaagtttgttgttgttgttgttgttgttgtttacggtagaatggctgaggaaggaaggagtaatggagtgaaaaaaatcaccatttggcaaccactgtggtggtggttggttcaagtggtagttattaatagacactaacgttggtgtgaggatgtttgatgagaaacagaatattgatgtagtcttgagatatctcccccaaaacatgtattaattacagagggagagctggtgaccaggtggtcgaggggtgggctatgctcacatcacgtgcctcccaaggagaaatactgagatgggcaccgcatccttgctgacaaaattgtattcctgacgacatcccagcctgagtctgggtacgagaaaacactgacagactctggttaggggacgtggcagagagggacaggcctgaactcttactattatgtgataagtacctttgtggatacaagtctgtatttaagagtattccttagaatagagttctaagaatgtagtaactagatcaaagaacaagaaattttaaagactctcaaaaagtataatcaaattatgtccctaaacctagcaccaatttatatccacactagtcatacataaaaaggacccattatattagctcaaaatagcagtgagtttatttgcacacattttaaaataaagatacaataaaccatagagccttagaaacgacccatttcaacttgcctgagagtaggaattagatatttctgatgcaagaatatcatctgtggtatccttcacagatgttcctcccaccccccgcataaacattttcaatgaaagtttatggattttatgtgtttcatggtggctaaatgattattaaaattttagggcttcccaaattactaaaggaaaatttgtcttttgtaatgttattaacctgtgcaataacctacagaaaacatctactgataatgggttctcaaaatgtaaggagttgatagaacttaaaaattcactcatgctttgtaaaagaaaaatatattgatagaatgaacaacagaaggagtaaatagcatttctgttgtttatttgtgataacattaaaaatactttcacatagataggcatgtgaaatatattatgtattaatatttcagaattattgtgaatatgaagttagcttatgtacataaataaggaaaatgtaggccaaggtagctaaatgcaaacacagaatatcagcattcatttacctcaggagaagttactagtgagtctttgaatttcatctgtgaaacaatttgtgtgataacatattttctgaaagaattaatcacttatttccctatgcataaaaacattgtccacaagtatccataggtcaagtctaaatatcattaaaatttgatttgcagtgagaagtctttatcgtatagttgataacgtctgttgaattttcattgatttggaaatgatgtggcttgtgtttggaattaagctattagaatattctgtcactataactctgcttcatataccagtgaagaaatcatcattcatttaagagtctaacaagatttgactaatatgaactctgctttgaattttggacatgttcctgattgtcacaccagaataccaccctcaaactacatagggtttgcagttgatcttcagtgtggaacttttgataagttcacgtttttacttgatcacatcgagcatatttggggttgatctttatctgtacgctatgctaatgcttaacataagtcctttatttacccttggttttgtattgaaatgttcacgcttatttcgacttaggttatttagtagtaagaaatatgacagacattatcttcatttgaaaaataagcatttgaaaatttaaattttttattttcttaaattttgcatattgaatttagctaccatgtcctttggactttttcactgagaccccagttttcccagccatattccgagtccagcccagtagagaatgtagtttggttagaacatagtgtgtaagtaattaaatttgtgccactacctaagtatgtctcagatagtcaaaaataagtgatacaatgtattcattatttgctatcagccatactattttctcccacattagtgtaggttattgattccattatctatttttgtcgcctcacctaggtaatgacaataaagtgatacatgggagagtttattcttagaaaaggaatgattttgggttactatttatgatgcttatctgaacaatgtaaagtgttacagagtcatattttaaatatacaaagagttcataaggaatactttgcggttcaggtaaaaataagctgtctagaaattaagtaggcttttgttttaaacttgattcatttatttgtactaaagtagcaggttcagtaacacaccatttatctggtcattttccagaataagatggaattttccaggtaactgatcataaattagttttccaggtaactgaatcttaaacttcaaggactgaaatcctataaatttaactattgttgatggaaatttttgtagaacatactttctaccttcttacttttctgtatcttttcaatcagaggatactcaataaaatttgatctgttttctggctcaggactactgttttttccacctccagtacctcttctttctcccttaatgagtttgctttttattcccagtggcttgtgaacccaaagttgttaggaattgttgtttctggtaagccaggatccagggaggctcagagtgagggtgtagggaagaaagagtattctttaatgttggtcttttttattagttgttatcaggcattcacatcttcccactttggttctggctttggcgctttgctctggaaggctgcttaatgggaggtcactgactcctggtacgttaggtctcacctggtagctttgcctcctcttcatggtggagtaaattgagccctgagagtatcatgggaatcactcaagctcacacacactaagtagtgatggaaccctgggtttaagacccaagtcttctgtctgcaagtctagtgttttcctactataactgtcatgttaactccaggtcattattaggaacatagttagtagtcttgataaataaagaaggctctgttatttcttagtgggattcttgcctctcactttcttacctatgttggaaactagagtcatcctagactcctctgcactctgcattcgaagggtgactaaagccttgtctagtttacagcctatgcagcctctagcatcttacctcctctgcgttcttgtcacatggccctctttcaggctcttttcgtctttagccctctttccctccttgttctcctccctgcctctggactcattgtcaaacacaccatgcatcggcactcagaaaaaagtagcaaaaacatggtagtggagaggagagactgtacaaacatgaacagctgaagggcagagaataagtaccaatgagtagaaaaatcaaaacagtccaattattctatcaaattatacatgtattagatcagaaagaaaatgattccagcactgtagccaacctaaaccatgtgattcaggtggagtttggtacagtgcaaaccttgagtgcatgtggtgtgtaacagagacatctctcttaccactctctgaagattaatgtcactcctgataagactctgattagaatcctatttccaacatgtggtgatgctaagtaaacagtactgacaaggctgaaggatgtgagctctactaagtgaattgaaaagttggataaaaagactcgctgataaagatgagaggacactgattactcatgaaaaggaaagaccaagggaggacttccatttgacttcaaaataacatgaattttattattctgatagtgccaccaaaataaatcctatgtattctccaggcagtaagggcttatgttataggcattgttttaaatgtaaatatttttatcaaccgaatatatttaagatgtgaaatcagttatccctataagtctgtaatgaaaaatggcagtactgggtactctgtttatccttaaaatttagaaattcatgttctgagaagtttttttggtattatttctttgataactttcttctctttttgtcttttatctcttttaagaactcttgctagtttcctgttgaatttgctggattgatcttcctgttttcatctatttttctttcatccatctctttggctgcttcccccgccccccattccttgtttcacgataattttttcttagttatgtgaatatattcaatatatttccttttgctttctttgttgcctgtttcatcttccatttattaaaaaaactgttattttcttgtaaaaacccttaacatgagatctaccctcttagcagattttttaaggtgtacaatacagtattgtgaatataggcacaatgctgtatagcagatctctggaacttgctcatattgctttattggaactttttaccttttgattagcaaatccctgcatttggcctccctgcccgacattgttctgttctctgcttctatgagtttcactattttaggaagctcattgaagtgaaatcatgcagtatttgttctctttgaccaggttatttatctccctgagcataagtctcaaccatcttgtcacatattgcaggatttcgctcttttttttaagttaatattccattatatgtatatactacattttctttacccattcatctgtcaccaggcatttaggtgcttctgtgtcttggctattgtggataatgctgcagtgaacatgggagtacagatgtctctttgacttctcagttcctttgggtacatatctggaagtgagattgctggatcatatagtaattatatttttaattttttgagaaacctccataccattttccataacggttgtacagttttgcattcctagaaacaatatatagcattcaaatttctccacatcctccccagcacttgtctttttttttggtggtcccatcccaacaggtgtgaggtggtgttgcactgtggcttagctttgcatgttactgcttccttttttatttctctcggtctctgcctttcacactagaggctttcctcggttgtttgtgatacaggtgttaagaaattacttaggtagatagtgagggtatggaagtcctcagtaaggttttccatttaatgaaaagcagccccaaatcattttcctttctaacagaaaaatctgtgaaatcaagctggaaatagatgccggcagttgtgccaatcatgttcaaaatggtggccccatcttcccttctctttatcagccacgtgtacatgtacagtaaggagcagacaagacagcgccagtcagtggacagctcatttgcataataagattagggtggggtggccagccttccccgtgggctgtgtaaatgtcatgcagtggctcactcctgtaatcccagcactttgggaggccaaggtgggcggatcacctgaggtcaggagttcgagaccagcctggccaacatggtgaaaccccgtctctacttaaaaatacaaaaaattagctgggcatggtgatacgcacctgtaatcccagctactcaggagactgaggcaggagaattgcttgaacccaggaggcggaggttggagtgagccaagatcacatcattgcactccaagagtgagactttgtctccaaaaaaataataaataaagaaaaagaaaactgttaggctataaagagtccctttgtttatctgttagcttaatttaaaagtaaaacatatactattctaattacatgcattaatgttgaatgttaccttcaaaagtttatagctcttatccctaatgccaacaacatctgattactttgcaccatatggctgcagtgtggtgtatggaaagaaagctggctggggacccagccaggctcagtcatactattctttagtagtgtgaccttatgcaggcttcttaacttctttgcttgaaagttttctcagctgtaaagcgcgggccttctataacatggtcccttagcatccttatatttgtaatattccctcattgtatgagaaactatgtctatattggtcgttctttttcagttagtaatcagatgttttctgtgtatgtatatgcgtgtctacatacacagcgtggttgaaaatacataaatacatgtagttaaaacaccacccccactcaaaatagatttaggctatatttgctaatggatcctcataagttcttgcagatattctcatccatgtgtcaatatttgcacataaatcattatccaggcactatatcattttttctcacatcttagaaatgcttttatgtaaacatattcctgaacatatttattactagtcaatatctagtactataatttataaattaataagaaatttaagtttttatttttttatctttttttaaaatctaattccccccctgcatgtttgacttgtgctggcagaataatttttttttttcttagacggagtctcactctgtcgcccaggctggagtgcagtggtgcgatctcggctcactgcaagctccgcctcctgggtccacaccattctccagcctgagcctcccaagtagctgtgactacaggcgcccgccaccacacccagctaattttttttttgtgtgtgtgtttttactagagacggggttgcaccatgttagccaggatggtctcgatctcctgaccttgtgatctgcctgcctcagcctcccaaagtgttgggattataggtgtgaactgctgcacccggccactagcagaataattttttaaaaaatctatgcatggggctcgttggctcatgcctgtaatcttagcacttgtggaggccaaggtgggcagatcacttgaggccaggagttgagaccagcctggccaacttggcgaaaccctgtttctacttaaaacaaaacaaaaaaaccccacaaaaattagccaggcatggtggctcacccctgtgatcccagctacttgggaggctgaggcacaagaattgctcgaacgtgggagatggaggttgcagtaagctgagattgtgccactccactccagcctgggcaacagagtgggactctgtctcaaaaaaaaaaacaaaaacaaaaaacaaacctatgcattgaaaagtgtctgaaagtaaataaagcaaatgttaacaatacttgtattcgttggaatttgaagtgatttttctgtgtatttaatatttttaacaattgatattttattgggaaaaatccattttaataaaagtaccatgctattatgaagtaattatgaatcagtagttgtttagttgaattataaaaccatattctttattgactattaaatcacacatcattaaaaatatttttttcttcaatctctctatttttttaattgaagtataatttacacatattaaaatgcacagattttaactataccctctgagtcttttacccactgtacttaaaatataaaacattccagtaatctcataaaattcccttaaatccctgttatccctcttaaatcagtccattccctcttcgcagacagctaccgatctgatacctatcatcatggattagtgttttctgtttggaacattgaataaatggaactatgcactcttgtgtctgactatcccattatccatttgatcactgcttacagatcttatgactgtcttaaaatacccattgttcttcttttcttaatgtctatgtaactggccctaagtcacacagctgggaagtgctagagccagggcctggcctcaggtccatgtgcccctgagctctttcccctaatcctgtgtgtgccgctttccaaggcccccgactggaaatccgcttgctggggagggttaggttggactgtaaatcactttgtcactctaaggaatttgttccttattcctcatatatggattctccattgtggcaccatgactctttggggttgaaaagaataacaaactgcaagcttgtttaaaaaataatccagtttttcttcagtgactattcatcaggcagcagctgtgagtcagatactgttctaagcaggctgctgactgcgccctggatgtgggatgatctgtctgtgctgtggagtccaggaacttgactcttgatgtgtcggcattttgaggtgtttccccttgagctggtcaggttccctggagaagactgtattcctcttctgcctagaaggtgatagcctggctgccagtgttcaggaagcagagttggggcctccgtgcacaaatccaggtaatctccctgttttcagtgaggcatcctggtggcagataccccagagtctccctctgcaaagagtgaacctccagtgctcctccagggtggagagggcagtcacctagtttgcatgtggggaaagggatccaggcactgatggtttttttcctgcctttcgtggagtctttcttattttggctctcctgggtgggaagacatgacagaccacgtggccttagtccccacattataaggaataaaatccagatttcttagcatgacatccaggatgtcatgggtgggtaggtggatggggtggggcagattttgtgttggcaattacattggccatttgtttgtcccattgccaactgcggctttgggcctcttgggtcagctttcacacctcccactgctgtgatgttttccagctgtccgcattttgtcttttcttgtgtttccacctttaaaagaaaatcctgtgctttttttttgtttttaaatcttggaaggcctttttgaaaaaatcagttcaggtataaatttcttttcattaattttgccttttaatgtatcctcttcactctgaggcaagttcagaaatctgaatttccttatttaccgtgaatcaatgtcatttcgactccaacacttgcctgtttccctgtcagcaaattatccttatttatgcttaaggtaaatctccccacttacctaggcaggccaatgctgtccatatcttggattccatgttaaggaatttgtattttattccttctaatgggagaactgaccaagtccacatggtttcctcgtgtctgcccacccggctacttctgtgccaggcttagggcacaggagtttatactctctatgcaaaccccagaacttcatgaacctggagtgggggcagaaaggcccattcaggcccagatcaagaggaagtcactctggtggctggatgacattttaagtaatagaagagggccaaagaaagtgttccaaaagcacacttatgctgtcggcatgattttatggttgtccacacaaagaggcagacggaatcttcttgaaagttttttgctggattccttttcttgttcctgtcccatcccccaaactggcatgtctcttcaatgcagtcactaactagtgtggctcagttcataggaaagagtgtctggttgttgtttgttgaatactttctgcgatcattatgcagacaagaagaccaaaagcagacagattatattagctctgtcttctttcctcatgccacctgtttgccaggttggtcatattttctatccccaagttaggggctgtggggagatggaggccaggggatctcacttggacctatcaaggagttggagcatggctataaatactttttccagttgctgcttagtttttagcaattccttcaaaactagatagagagagttggtgcttagtttttagcagttccttcacaactagatagataggtaggtagatagacagagcttaaaacaattattagcaagtttccatgggattttaatgggaaaaggagagaggaaatgttgggcctttgcctttattacctggagtacgcagaagagggtttcttgaggaagttttaggctagaacagctgagtttctgcccgccttgaaagtccactatcagagagatccctgctgcctggagctcagtggagatggatggacttgcctggctcattaagagcagggccgtatcacatctgtctttcaaaaccttgcatctgacataattcgtgatgtgtaataggtgctcaataaagggttgtagattgaatgactaaatgaggcagcgatcaccatggcagtcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcatctgatgggagctgttgccagctgcagccagtaggcataatgacatacctcctaattttttttagatttaagtaaaactctggatggtagtgtgaaatatctttacttttcatttcaaatttatgatattttgagtcacaaaaaaaacacatatgtggatcacatttgattgaaggccttctcattgtcctctctggtaaacccaaaagaagagggaggccgggtgtggtggctgacgccggtaatcctagcactttggaagaccaaggcaggtggatcagctgaggtcaggagttcaagaccagcctggccaacatgacgaaaccccatcactactaaaaatacaaaaattagccagacatggttgcagtcgcctgtaatctcagctattcgggaggccgagacaggagaatcgcttgaacctgggaggcagaggttgcagtgggccgaaattgccccactttactgcagtctgggtgaaagagtgatacttcatctcaaaaacaaaaaaagaagaggcctgggttgctgggaaccttcatttaaggggcaagtggaagaaaaataatccttcaacaagactgaaaaggcgcagttaaagaaccagagagagaagtgactctgaatctaagaagaagactttaaggaaggctggtcaaggttgatggacatctgctatgatatgtgctatggggaagtcagagaacacagtgaattgcttatgaatgcagggagaatgcacattcacatgcagctattttgggtctgacacaagcatggtgcagtctgtgacactggtatcacttggaccaaacttgcttttaaagttgtttccataaggctctggcaagaaaagagtccaagatcatataaatttttatgttgaaagccatcattcgtatatctataataaaggactttaaaggagtatttaaaatatttcaaggaatttacatgaaactgtcaaggaatcactatttttatatcttcaccatgatagggtggaccttcgtcttgtcttttgggggaagttatgacagtagatcctattccaggaagttttattttactggaggaaagcccagttaaaatcccagtgttaatttcctgtcatgttaactaccaaagaacagatttccaaagtgtctcaaacatttgacacaatcatttccgttttctaaacttgatctgtgtttcttgggtgatacatgcattctgattcgaaattgaacaaagtatattcttaagtataactatatcctgtctaaggcagtggactcatggagtatgttttcatttttatgttaattgtcgagagtttataagtcattgtaaattagtctgagtgctttgtgtgagttagaaattgtctagtagagcaaaacccttttactaaactcctcctgtgtgcttccacttgctcagagccatgcaggcaacttcttacatgcagaggagggcgtaatctaagccatacgctggtcattgggtggacttccatgcctctatgcctttctcatgtgtgtttgcctctgcctgtaattttccatccattcccaacctcttttccttctcttccttcttatgaagtcctagttatgcttcagggatgatttaatatgtcagtccttctgtagagatccctaagaccttcttaccactgtacccatgaaactttatatataactatggatatggcacttatcaaataatatatttggtatttatttttctcttccacatgactgtgtatatcctaaagtccatgtcactaatttctgcatctaggcatgtatctgacataggggagcttttcagtaactgatggttgaattaggtggaattcctccaataagacatcaccccaatgcatgacttaggcaaataaggtattaaccctgtgtggtgttgaagaaccattaagcttaagagtattaaggagctaaatgccctcttatgttttgttatgtaatttaaacagaggaacaaaaaataaaattctttaagagaagaaggactagatatgtccgtaagccttgataaactaattataaaacttgtgggtgcagcacatcaacatggcacatgtatacatatgtaacaaacctgcacattgtgcacatgtaccctcaaaattaaagtataatgatagaaacttgacacaattatattttaacgtatttcacattgatttaaaatttaattgtcgataagtcatcagcggcaaacccaaactgtagaattttaattcccaatgatagatttttctaatctgtagtagatttcttattatgttatggcctgatacacatagcttagatgtgccttgagtaaaatcatgaccctgaaatctagcgactgtagatgttttacatattagaacttagggcataatttttctccccaacagcagggctggaaaggtgattacatttcagaagggtcctttcagcctgtgccttgtagcgatttggggcatgaccctttgctttacacctgcatagctggtgtggccttttctcccaggctcctgggctgggcctttcctctttcagagagaaggacccagggaagaggggctgaaatgggagacatcgttgtgtgccaagcataggatcatgcctggcctatggtaggttagcatttaataagtgtttatgcaatattgcttgattaaaatagcattgatcttttaatcaataacattattaaaataaaaatgttttaaaatgttaaaaatattttaatatctttacaataactattggctatgccttacagtactattgtctctctttaaacctctcttagaaactgtgtgttaggtttggttttattctttgattactagaagtgcttttaaagaaggtacagagctctaaaaagggcttctttcaagtgtagagagagaaattagaaaaaacatcaaagacaaagacttctaagaaggaaaataaaaattgatttaccttcgctttagaagcttcccaaaaggggagactaggaaaaatagcagaccagaccatactgaaggcttcctttattccctctgttgtctcattccctggtgccaagagcctctttggggagattacactttatggcaaggttgcatttgttgttattttgttctcatctccatctgggacaagcttaggcataattcctatttgtatttcaaattttcctgccaaaaacgtgttgacctatgtctccaaagtaacggaggttatgcatcatttctactctagttgtggaaatcgacaaaataatgtttctaccactagcaagaaaaattgagatgttactgtagagaacttgccattgaaatggcattagtgataggatttgacgttttgaaaaaatagatcccattcttcttggcttcctgttatactccttgcttaatttctgtttcatggacgcgatcactatctgttgcaagtgtgaggatgaagccacagatggctagactctgaccccataggggagccattcttactaaagagatggctcttaagaccaaatggagcactggtagaatgggtgccaggtgagtgggagagactgccttcctcatggtctgctcgtggctggtaatatccttgcaggggccacctctactcgtagggaataaggatgacacatagccacataaaggcaggtctggaaactcgcaagatgtccacctgcttacttctgagaaaaaaagtttggaatggtgcactctgtatgtttctcagcaggcagagcgctgggtttgttgagtgagattgtgttacacgtactcatagacacaggcaggagttacctggacttcatgtttacagtgtgttttaaattctattgatgttcgtatgttgtgaattccattttgggtgtattctgtacgaaaggatgatcttttcagagtatgtaatgaatattaacttcttagtgacttcagaagacccatttattggttacttgatagtacaaacaccaacagccatctgagttctgtaaattgttactgagatgagcttttttatttttgaaaaacgatcatttctctatgcatagattattatcactggccatctctactactgctcaactgaattccttcctcaaccataaccattgtgtagtttttatatttgattattttcctcatatatcgttatccttgactaaaggcctttctccttaggaaatgctttagactacctggccttatagcatcaatttcatttttaaatgcctgtggagacatgcttgactgcatatgaattttctagtagagttctgtaagaattcttcacctcccaaagaccatatgtatccatcttggttcccaacagtttataactgccagaataatttaaaagacattttccctttgcaagttaatttagaatagaacatattttgtcagagaaagtggtgtgggaaacagcttggatcaagcagccacagacctctagcgacctcacaggcagcatggggcctgtagagggcactgcaccaggagtctgatgatgtggcctgggtcccggccatgcccaaatgaggggcgaagtctttcccagtcacttctgctctcttggcttaagtttcttcacatggaaaatgagtcgttggcctaatgatgccccaaagtagcgtttagattttaaaatgtcattgattctagattttaacatctacaagttcaacatgaacgtcgacagctcatttagtcttcataatcctctttgtaccaaagcagattttgtgatcgcattctgaaaacatcaggaaaactaggatatgctacagcacttaccaaccataaaatcaggaaatctaggttatgctacagcacttaccaaccaagaaatctcagtggcttaaagcaagtttatttcctgcttagggtgcacagttagtgtgggttgagtgaggtgtcactgctcgtcacagttacccagggactcaggctgatggagcagctgccatctcagatgctgctgatagctgtcagagggaagcagtatggtggatttgtataaaactcacggactcctgagccttgtactgtaactgagtccctaacttctgcctgcctttcttttctgcagcaggtgaccatcactgatggagggggcaggagagtgtgctcctaccaggactgggaggagagctggtgctatgtggtgggcggcagtattggcaccacatgttacagagggctgcttctgaccaaagccaactttaggagagagttttaattgacgcctaacagacctttgctgggctcatttccatactgtgcccaatgagaaagaactatgaggaatggggaaaaggcctcaggtagaaagtagagaagagtcatgggattgatgcaggggtcagaaaaatggtggggcacaccaaataaacattttggcaggcggtcaaaaggcctagagttaatggctaaagtgaggccaagatgatattgaaaatgttcatctttcatgttgaaagactaatgtgcagtcacttctagcatgatggggatcgtggttttcctcatagctgtcccctgtagaagtctcagttactcctcatccttcaagacttaatgcaaatatttatctgcgtgtattttcttttcctactgaaatgtgaatgtttccaggacaaggagccatttcatcctagcacctagtttacaggcactaagtgaatattacatgattgaaatgaaaccacctggcaaccctctgctatggtgcccatgtgcctgccatcctctggctggttcagcattttaccaggccagagctgggcacagaattggttctgtagaagcagctaaagcaagatgacatttctgagacttctggccgctgttctgttaattttggtgctgtcaagcgaaagggtaatcaaatagtactttgaaatctgaaaagtgaaaagagaaaagtaaactcatacctaaaatataatttctgttctgtatattctagtttccttcttttgagttgctgtccatttagtgtagtgcaatcaagaatacctaaatcagtataacctcgtcattgaaagaaagactttagtaacctattgatatttctgtcttcattattttattattatgaaattgctgaaaataattacacaagtgatataacttttaatcgttgggatgcaaaacagtggttctcaagcttcagagtgcctcagggttgcctggagggcttgctggggccccactcccagagtgtgcatttcaggtggtctggggtggggcctgggagtcagcatttctgtggagttccctgaggatgatgacaccgcgggtctgggaaccacactgtaacgaacaatgatgtacaggaaagggcactggaaacagaaaagcatgggtgtgaatcctccatgctccctaataaccatatgacagtaggtctctcggcccctctaatcctctgtttccaccttgtggaacgtgaaggccctagttgacctaacagatgatcagatgaggttgtacactaaagccgtttttaaaaaaataaggctctctgaaggtatcttcttacaatatcctacagattgagaatcatggacacttgttttacattcagagtatacacagctctgtaccaggtagtggaaaacaggacatggaaagaaaaagagaacaggagaaatgtggcacatgccaagcaccaaaatgagtgatgtgactgtttaaaattaagagaaagacacgctgtggtgggctgcccaggggggacgtctcccaaactgtactgcgtaaagaccatcatttcacaaggaacctgtggtcactttgtgttccaggatggcttattgcacgggtagcgtcctggaatctagaaatctctcatattagtgcatttgggtagtttatcttttcttggactcaatctcaggttacctacccgttagagtttatgaagttaagagtttaaagttcctcattttgcaagcatttaaaagtcatcatctcaacaaggaggtgctactgtaaatataagtatcagaaagatctatgaagtcatcttttcacacttttgatttaactaattgagggaggggaggaaaatctgaaaatctcaaggaatttttaatcttaagattaaaaaatgtagctcatacatagttgaccagcactagcatttttcttttaaggtgtgtgaccttgtctacacttagagttttagataatttttattatgatttaaccctaatgttttaaaattacaattaatagtaggtttagaaattaatgttgtaagtaatatattaacatttttactctactttaagtgctttgatagccacatatttaaggttggataaaaactgtaatttaacagtcataattattataattgatctgaataaaaatatgaactaactgtattggtcaaagcaagttatgtggtaaataaaaattaacaataaaattgaggttttaaaacttaccttgggcaaagactgtatctgggtgatagattgagctctagacagtgaagtgtacctatggatactaactgccgttatgattaataaacacgttgttatacttcaattgtaatagcattttattatgtattatttttcaccaaagaatactaacaggccagttaccactgtgcaggttctgtttaaactcttggcattaaaaaaggaatcctcattcatacttgaaaaagattggaaatccctgacctagtccatgcttgtccatgatactaccctggcccttcatcttgactgactctgtagatcactgttaatgttggtttatgtatttcttacccttttggatagataccttttctaaaggaagcaatgatggaaaactggctgttagctaggttgagatgtgtgcacacttcattacactcttaacaggcagatacccgtcagccttaaaggatgactttttgccaccctgctttcctttctgcctggccatctgcttcttagaatcttccctgaccatgctgtatgttccagtaccttctttgttgaagaacgtattggaaagcatagtcagtgtcttttaacctgattcttccttctgttcttttgaagacagctttgattgtttctaaagtgccaatggaaaaataaatccaagaatttgtctccccagtttttgaaaaattgtagtgtagggcaactgtaaaacacatactatgtactataagtttcccacaattaaatcagtatgaatagttgttgaaatgcatcagttgaatagattagagattcaagtatatatgaagatctgaaatgtaatagacctggcaaaactcagttcatggaaggtggttgattcaataaatatcattgatataactgattatacatctggaaaaaataattgtaggaacccttcccacactgtatacaaaaattaattctagatgaattattgttctaaatgttctaaaaatacacaagtaatagaggtaggtcttaaacctgggtctgtcttactccaaaactactgagctacattttaaatgttaatagataatgcgagattacgagtcccaaagatgagaggagagaaacattttcttttgctaacatttgactttttattttttgtcgtaaacaatgctgagatgaacatcctaatgtctacattggtaagtggatacatgattattttctttttaacacattcctggaaatgaaatagctgtgtttgagggcacccaggcttttgaaataaacttccagattgctctccagaaaggctgtgctaaattagtgactttattcttttgtcatgtttaatatcccactatttttctcttcagaccatcttttgttatggagaaggattgtactcccatcttccttttatattggcaagtttctaattaacctagggcttcctgtgaaatagggagaagctgatattttgtatccttttatcatctatattaataagctcataaagaaagtatcactttgacctcagatatctccttctctagcattaatcggagacttctgttaagatccagccatatagaacaacaacagtagggttttactctccctactatcaatatattggctgtgctggaggtgaggcgccccccttcctcctgcagccagagagctgcatccctgggaagaacctgctcttacatgactttaactacttgccattcaatgtaagtgcagcatatttccaaactgcgtaaaaaatgagctgtgtgaaggcttcctcctgtctttgttatctttcatgcaaacagttctttttgatagaatttggaatttaccgaattcattccgaaggctgtgaaatgtgatctctatgagttatagtcttcctgtgaggatgcgttgtttttgtggaaggcaccaccgggttgacacagtattatttatttttctcccacatacttcttgtaccttcctctgtaaccaatatgagactgtattgaagagaaataatcttgccaagtatttgatatacatagaattctttgtgagttgctatcttaacttaaaaattttaatatgctaaatatccatgtgccaaaggaaaataaaagtaagttcttttcagagcagggacttttatgtcttacagtattcagtgtgaagtaggatagaggtatatcatcgatcacagtgcacaccagacagaatttagagtgtttacatctgcgatcagagttacctggtctcagggcagagcatgttttgttttttttccctactttttagcaaagacttaggctattgtaaataagctgaaaattatcacagaaattgttgaagttggctctgaacaagaatgcttgatctttctataaacagctttattaatgcacgtcaaggcactgttctctaccatttccttctgcttgttgcagaccagctaatgtgttaacagagatctgaatcatgacctttttttcccataggcataggccgactctttccttgagctaaaatttagccagaaaggaaaaaaaaacccattttggtgcatgtggcatgaaaatgaaacaatgcagctttatttagggtctcctttaacctacatcttaaaaatatattttaagtctgtaatatgcctattaaacattagcacagttatcaaaataatgatatttgtaaaatcaatgtgaatatgtgaaatttgtagctttatatacaaatcatatacatgggcatgcatgcatacatatttcaacatattaatatgtgtctatctcaatatatgcatatctcaaatttacatatgtatatcttatacatatataattgagatagcaccaattataaaggatttcttaaagaggctgcaaatttaggcatttgtcattaaataatcccataatatttcagtgcctgaaatcattctagcctttatattgtagtcatttgcgttttcttcccttttctaaatgtagtctccagatgaattaatatactcacaatcaacatactgtggcacgagtaagaactatgtgtattagacaagttcaaagcagtcctgacgctcacttgactaaggcatgtgcctcatgtcccctttaccttcagctcttctgggccactgctgggtgctcattgctgctcctgtgctgactgtctgcagtgtgtgccgtggaatacttctttgcctatttatcatatctttggttcctctccatccttaatgctgaacttttagagcatgtagaacaaatcagaagtctcttgtgctgattatatccatttgacagatgtgttcagaaattttcttgcactcattaaaatataaagtaaaaattgaaatgctttatatgatattaatatggatattactatgacaagtgatagcttacaatgaaaagatttcttttaagaactcttgccatatttccttctattttcatgttttgatatttctagaaaatgtttttactgtattcaagattagggttttgtaatttttagcaatactgctgtggagcctagttgaaattagtgtattactttagttcagactttcttcttatcattcttgattgttaaaagaaataaaggtttacacagaatgtatagcagtgttgagtgaactcaaccagcttttaatatattttttagaaggttaggagaaagattaacctatttaaggacctaacctacttttacatcctgcaaactattttttttaaattttaaaacatttttcgtttttgttcttttgtattttgtttattgtaaccgtagtttgtcaggagttacaacccggccaacaccgggggtggggggcccaacatcacacatctgtgtttgtaatgtagtatttattaatacaggtcatataacattaatgtgtcagcacctcatggatatgtgaattatttaaaatgagcatctgggtactattttttgatatttgaaataaactgaatttttaatgttcatatgttatacgatatgccaagattatcctggtaaagttttcatatccaactggggaatcagcagcaatgtttctccctcatttcttgggtcaagcaagcctaaagttggacacaacctttaaaatgagctgattatggacacatttatacatcattttgttaataagttgtgcatcagttaaactgaaagcttgctttgcttgcctcattggtttttttttttttaatttttctggaattaaaaccactgaaaaataagtccagaaacatcaatttggctgaccttagtttccccctaaatttagtagttttatacagcagaaaacttgtaaagttacttatttacagacaggctctcagtgtgtcacccaggctggagtacagcagcacgatcacggctcaccgcagcctgagactcgtgggttcgagcagtgtttccaccctggcctcccgaagagttgagattacaggcatgagccactgcacctggcctaaatttttttttgttgttgtttttaaggaacaattttctttacagaattatttagaattagaaattgtgaatcacattatcaagcttttaaaaactcttaatttaattgagaaaattaagtattaatactatggcctgggtcgttcgggttgtagtgtgatacaactcctaaacatgaaagattttactcttcttcttcttcttcttttttttttgagccggagcctcgctctgtcgcccaggctggagtgcggtggcgcaatcttggctcactgcaagctccacctcccgggttcatgccattctctgcctcagcctcctgagtagctgggactacaggcgcccaccaccaagcctggctaattttttgtatttttagtagagacggggtttcactgtattagcaaggatggtctcgatcgatctcctgaccttgtgatccacccgccttggcctcccaaagtgtggggattacaggtgtgagccaccgcgcccagctgattttactcttttgaaccctgtggttcctggaagttgaagtcctgtcccccagtagatgcttgttgaatgaatgctcactcagccactctttttgccagaggctactagtttctcacctacctcttctccctctcatctaggctgacatactctgaaagcaaggcagaatttgctcatatattcatttatgatccatattttttccttggaaataattattttcattttgctggaccacgttttagagagcctcacttctgttgatttgattctgagcaatgtttctgagctggactgaccacagagtaagatcttaccttattcatggctgtgaatcatattgagccatttgtcttagctgtcatgcaatttgctaattaggtcattctaggggttgagggaaatgaaagactttgaaataatcattaccttctcagaacaaagcagcagcagttaaatgcttttgcccagtcattttactctgatgttcaataaattcagaagtggaaggtaagttgggatcttactgttgcataattatgctttccagtttatctgaagattgtgcagaagatatttaaatcagtgtcttacacagttataagttgtatatttctgtttttcttattacattttttatcataaaactaaaacctattagttgaagaacatttggaaaatacagagaaatagtaaataaaaaatttaaaagtactcctcatcctaccatctagtataattatttgatggatttctttctggtctttcctattcatatatttttcataaaacttaattattgccttatattgtacaacaatagctgacattttctgagtgtctatttcatagcaggcagtgatctaagagctttaaatgcattatctacttaatgttcatagcaatctaggaggcagttattttccaatgatgaatctgaaacttaagattttgctctatgtcaaaaaatgagaaatttaagacttctagcttggacaaaatggcacagacctgtttctcccactttctcccaactaaatacaatgatagaccccagaaataatgcaagaaacagaaggagaactctaaaacttggtaggaagaagtcaagatggtttggggcccaggactaaaggactgacacaatggcagggcatctcacattccctcacccatcaggagaggcagacctggcctttcttgacctctgaactagcaaccgagatagtccagggaggctgcttcctttttttattcaaatggaagcaagcaagcagccaagggaaatactcttctttcttgctgagatacccttttccagtgtgtgatacctgggcttctgtgaagcaattgttagaaggatcccactgcaacaaatggtccagctgagtagcttctttgtcctcatgcacctaagaccaccttcttctgcccagagaggaataggtggttaggaaagcctaatccattctgtgggcctgaacaccaccactccttctactgagggacactgggcattaggcctggggaagtcccttcactccctcaggcagcatcagcagggacccgtgggagcccccatcagaaccagacaaatgaagcgggcacaaagaatgctgcaaaggctctgaaaattaagctggccctggaaccatagcccacaaaagtagaccaggacccacatactaagcctaaacagggtgactgcctagacaggaaatcagcaaggatgtagaaggtctgaacaacacaatcaagcaacaggactaaattgacgtttctggaatacttcacccagaaaccacagaatacatagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgcaggtaaagcagttctgagagtgaaatttatggcactaaattactacattaaaaatgaggagagatagagaaagatagttcaatagaagcctccagagattgtactcactcctccataggatcaccaaattacccacagaaaaaatcatcttcataagaaccaagaatcaggtgagcaatcacagtacctggttttagcatcatactaaggaaagaggcactgaggagagtaggagagatagtcttcaatcacctaggccacctttccctcatccaaaaaatataactgataaacaaattcattatagttgctgaatacaaaattaacatccaaaaaggagtagtatttgtctatgccaaaaacaaacaatctgaaaaaagaaatcaagaaactaatcccatttacaatagctacaaaaaaatactaggaattaagttaaccagagaagtgaaaaatccctgtaaggaaaactataaaactttttgcaagaaattgaagaggacacgcaaaaaaatggaaagatattacatgtttgtagatttgaagaatcaatattgttcaaatgtccatattacccagggcaatctatagattcaatgcaatccctatcaaaatacccatgaattcttcacagaaatagaaaaacaatcctaaaatttaaatggaaccacaaaaagccaagaatagacaaatttatcctaaacaaaaagaacataacttgaggagtcacatttacatgacttgaagttatactacagagctatagtaaccaaaacaacatggtatgggcataaaaataggcaagttgaccagtggaacaaaattaaaatccagaaataaatctatacacctacagtgaactcacttttgacaaaggtgccaagaatatacattggggaaaggacactcttttcagtaaatgttgctgggaaaactggatatccatatacagaagaatgaaactagacctctatgtctcatcacatacaaaaatcaaaatggattaaaaactttaagatgtgaagattatgaaactagtaaaagaaaacattggggaaactctccagggcattggatggggtaaggatttcttgagtaatactctacaaatatgggcaaacaaagcaaaaatggacaaatgagatcacatgaagttaaaaagcttctgcacagcaaaggaaaacaatcaacaaagcaaagagacaattcagtgggagaaaatatttgcaaaccatccatctgacaagggattagtaaccagcatatataaggagttcaagcaactctataggaaaatatttaataatctgattaaaaaatggacaaaagatctgaatagatattttgcaaaagaagacatacaaatggcaaacaggtgtattaaacgtcattgatcatcagagaaatgcaaatcaaaaccattatacaacaaggtatcatctcactccagttaaaatggcttttatcttaaagacaggcagtaacaaatgctggcaagaatgtggagaaaagggaatcctcatacactatcggtgggaatgtaaattagggaaaccaccatggagagcagtttggaggtttctcaaaaaagtaaaaatagagctaccatatgatccagcaaagccactgttaggtatatatgccaaagaaaggaatcagtataccgaagaggtatctgtacttctatgttttttgcagcactattcacaatagccaacatttgtaagcaacctaagtgttcttcagcagatgaatggataaagaaaatgtgatacatatacacgatggagtatattcagccataaagaaaaatgagatcctgtcatttgcaacaacactcgttttgttaagtggagtaggtcaagcacagaaggacaaacttcatgtgttctcagtcatttatgggagctaagaaaagtaaaacaattgaactcatggagataaagggtagaatggttccctgaggctggaaaaggttggtgggggtgcagcaagtagggatggttaatgggtacaaaaatatagttagaatgaataagatctagtatttcatagtacaacagggtgactaaagtcaataatttattatacatttaataactagaggccaggtgtggtggctcacaccttgtaatcccagcactttgggaggctgaggcaggctgattatctcaggtcaggattttgagaccagtctggcgaacctggtgaaacctcgtctctactaaaaatacaaaaattaagccaggtgtggtggtgcacacctgtaatcccagctactctggagactgaggcaggaggcagtgagccaagatcacgccactgcactccagcctgggcagcagagtgagattctgtttcaaataaataaataaaaataaaataactagaagagtataattggattgtttgtaacacaaagaagggattagtacttacgtgatggatacccataccccgtttaccctgatgtgattattacacattgtatgtctgtatcacaatatctcatgtaccccttaaatatttacacatactgtagactcacaaaaattaaaaatattaaaaaataaggaaaggtctcaaatcaataatctaagttaatacctcaagaaattaggaaaagaagagcaaaataaatccagaacaagcagaaggaaagagataataaaagcaaaagtcgacaaaactgaaaatagggaaacagtagaaaaaaaatcaatgtatcaaaaacctggtcctttaaaaactttaataaaattgataaatctgtaacaaaatcgagaggaaaagaggacacaaatctgtaatatcaagaatgaaatgggacaacagtacagatcctaaagccactaaaggactcataaaggacaagattacactcacacattttccaactaagaagaaatgaggtcagtttgtcaaaaactgcaaactaatactcaaccaggatgaaatagataatctgaagagtcctgtaaccattagggaaatggagagagggtagtggctatggtcacaaaagagcaagaccaggggtcctgatggcaatagaaatgttcagtgtcttgatgtggtgatggacacaggaacccacacatgtgctaacattttatagaattaagtacacacctacaagtaaatatcaaactgaggaaatctgagtaagataattggattatatccatgtcaaagaaatcctggtcccagcattgtactaaggctttcaaaatgttgccattggggataactcagtaaagggtactcagaatctctttgtattacatcctataacttgcatgtgaatctgttattatctcagttaaattttcgattaaaaaaagctagcagcttgttactttaggagttgaaccctgactgtatgactccagagaccttgttctcattcacacgtctgcatctccatgttatgttgagacattgcattcctagtagttttacatgatcacatgtagatcataccatatgtaaatagaaaagtatgcttgtacattgtctttaacagcaattatcagtattagacaaagcatagttttgtttccctcccccaccccccgaccctgttcctgtctcatagtttgaagtttcccttaagtattcacagttatagtccccaaagactttagatgccacgtggcatgcgtaaagccagcatattctattgaaatggccggtatagttgccgaatcagatgtttttagcttacagaaatgacaatttcatatgacatttcttttcatatgttcaaagaaattacttgagcaaaatgggagatttctggagtaggccataggatcaaaggagttgctggaggggacaagagagctctagtatcctcagagtttggaacctaggacacattctttttatttccatctcatactttcttctccctggattttggcacatactgcctgcagtggaatcattggtggtttccagtatcttctttgaccagtcctgcagtctgaaggaaataacttctgtattccaggatttgtttgaaaagatcatagagaagattagaattagcctggcttggatcacagccctacacttttccagtcactgggcaagaggcagtgattggcctggtacaggccatgtggacagggagggagaggttattgctctgtgaagggagtaagagctgggagggggcagaggggcaatgcagacacagctgttagagcgaccgctgggatccagcagctgctgaagcctgtgtctgagattatcaagtcaagatatctaaatggcagttaaatcatgaacataaaaataattttcaaagtatgcttaattgttcagttttttaattcagcagaatttttctcctctgctaatgacaaggcagtctatattagagactgtcaaaattatttcttaagaagcatttaaacaaataatttttgtagactgctatatgcatttcattagacaaatgtatattctgctacaaattcacataatcatttttccctcactctactcaagactacttagattgtttgaaagaaggctttggctaatgggtattggaaggaatggctgattgttttaaaatatcctgttgcatacaggatgtatttttttgaagggttaagaatgaaaataggaagcaagcatgttccctctgactgaaattactttccttgaagccattagtgtgtaagtcagatgctgaacttacgatatatagatattatataatatgttacatatatacttgaaaataaaattccaaacagaataatgactgttgcatggatatataatggagtaatttactatgatgaagtctgacttgatagcacatcaacacagtaagcctcattttgaacagttctgctgtttcctttgtgaaatggtagttggaagtattgtccgcggttatgcagcatggtgtttatgaagacctttgtggactctgcttggatccatttccaggaaaaaaaatttctctgccagtgaacttttatgtttcttttgccagaaaatggagaaagatgaatgtttcaaatttttttttaagtgccaggatacttagaagcagcctggttcagtgccaagatgtagtaatcagcttcctcagatgtagtcattcattgacgctcttttctgattcaccaccagtgtcttgcaagagctttcactttatctgcctgcagccctgttttaacagtagtgttgacacaactcacctgtgtccatttgtgatttctaaatagtttttaaatcataaatatttgaacctcaaggtaacgctgtaaagtatgaatagagatgacattgtattttttcaaaaaaaaaaaaaaaacacaaaaatctaaacggaaacaagcacagatgaacttaatgtcagtgtaaattgtagattatagacttcacaaggctggtctttgttttgttcactgtatcccttgctcctagtatagtgcttgacaataaatgtttcaggatgattgatgttgaataaacttaaaaagtactcagcacctcacaactttgaagaacatggaaacacttgtattggcagaagacagaaatgtgtagccccaggagacaggagatagctcaaagcaacctgtcatgagcacatttctttgaagcctggtgttttatcttaataacccatacaaaattgaattcttctttgtattaggaatgtttgttttatcatagagattgttttaaatgttacttatcataaaatattatgcttccgcaaaatacactgtttatcttgaataccctagcgtatctttagaagtacgtacttctattgcttttgaaaaatacaaatgtccaattaattacattttattgatgtactgtctatatgctgatgatatccaaatgtatgtcttttatctttatttcatctctgtaattaccattttagttaatggcaagtgtgtttttccagttgattgagaaaaaaaattctaagtcatccttgatgtgtgttttgtttttttttaaacttatatccagtgtgttggatagtatcattgggtttgacttgagaatatatctggaatttggtcatttttaaccattcctactactgctaccaatctgccgccattgtctcttacctggattcctgcactgggtttttagctggcctgtgggttttcccttgcaccccacagcccagtctccacacagcgttggcacgatcctgtaaaaacatcagagcaggtggcacccttctcagcactctccagtggccacccatttaaacagagttcagacccacgtctccactgggcctggcagagccctctctgtatcctcctctcctactacccctccccagctctgctcttccagcctctctggcctctttcctgttcctccaacctgcccgagttgctgctgcttctggggtctgcatttgctcttcccgaaggtgtccagatggctgtttcctacacttcctttgagtcttttctcaaaacatttcaatgaggtcatccccattcattccacctacaatttcgcaccaacccccaaacataaggtcctttctcacattttttttcttttggcacttatcacatctaacatactatatgttttatgtggtgaggatattgaatttctttccttcccttcccccttccccacccctagtgcaatgctagattgcaagcttgatgagggtaggggagaaaggcacctgttacctaagagacctgccaggaaatctttgcttcatcctgatctgtctccacagttctattagaatccttcctttttactctccttgtttttcttcaagggcagggggttgatccctaacaccctcaaaagactgcctcttggctttaggatattaagccaactttttgacaaaaacacatctgagctgctttccttgggcgtcagggatggagcttttattgaagaaaagaaagacactgtctcctctctggtcacttgtttgttcctgggtttcataggtgtgtttctacgtgttagactccacaagcagtgaaactcggagatctctgagaacataagctttctcatgagcactgttttccctgtgggtaggccacccctaaggtggtggtggtggtgtttatttccctaaatggtagttacgggtcaggtgtgattcctggcacatggtaaatgctcagtaaataatttctgaatcaagactggttccctcaattttaatctgatgacttattttctccttatatggattatacttggccttcccattttaacattctgaagctgcaggagatattattaaaggccaggctacaaagagctcacgttcccttccagaatacactgtttctaacaagcaagctgaataaatttctctgaatctggatttaaacaaaattcattataagactggccttgcatttggaacatgttcttataaggaacctgtaagtcatgaatatttcactttcttttctaagttttcttttcaaatgcacatttgctttcattttcttgttaaaatggattgagaaagattaacacaaatgctggtgggaaaaaatatagaggaaataagcattcataaatattttaggcctccgtttttcaacaacccacagctgtgtgtacatagttgatctgggacagaatgccacgccttgtctctacaatgtgttgcctcagagccagtgttcacctggggaatagaacttggatgtttcggaaactgcatagcaccctagtgaaaaatgcttccaagtgcaagacagactcttatctccaaggattccagaccgtattctaccgtttccaaaaataacctgccatcatcagctttgatccctacctttaagataacattttattttctatttgttcaagtaaaacatgttcataaaaagtactttggccttttcttccatagattgtaagtgtaaaaatttgcctaggtttcggtctcagccaagatggtcaactgcatatactactgagttctgaataccatgttagctattgagaaagaataaaagctagagggatgcatgggtgctaaaaactaacaacaaaaatgctaggaaccccttgggagactgaagtgggctttagcttctgtatagtggctaagtagacgggtagctgcagcctgtggacgaggcagccataggtgtctggagagtctggaggaaactggtttttaaaactattttttctaagttatgataaagtatacataacataaacttaccatttttaagtgtactgtttggtggcactaagtgcaatcacgttaagttctgcttttgcctctcctattgccttccctgaattttatttccagcccaattgtcactcacacgtgaggatataagaagtatcttcagctatacaagaccttataaaagtttctatataaagagccacactgaaacatgctgggaggaaatacttaaatatgaagggaagcaaatacacgggcagctacaagagataggggaggtaagggggatcaagtcccctggcaaagttcattgatgtcttgaaaaagaaggctaggacataagaaaacagaaaatacatgcaagtaacccagagctaaacttctagatgttaccgttattgagtggaggagaaaccaaagacggtagggatgaagaaacatacagatggatctgctggggagacattgtgaaaatgaaaagcaagaggtgcagcttttaaaccagcagaagaaaattggatctagccaatcaaaaataggaaaggggaagtgggatggaaagaataaaacaaaaataaaatacagtaaatggaaaatatgaaaaaaagctggaaaagttcaagttttagagtaattacaacgtatattcctggattatccatcgtaaagatgtattctcagatggggcggaaaaacaagatacaaaaaataggttataagagacacacttcaaaagaagttggaaataaaaggatggaagagagagtacacaaatatgaaccaacagaaagcagtggtaacttaaatatattattaaagatgaagaggaatgctatatattgataaagggaatatgacaagaagatgtaaccataaaaaatggtaatctgcaatatagtttgaaaatatatccagcaacaattgacagaattgcagagagacatcaacagttgtagctgaaatttttaacacactgttctcagaaattagtaaatcctacagttgaaaagcaggcagaggtggagaaaacttgaaaaatacaattaataagcatgagctgttaggaatacacctaaaactgcatacttgagacaatgtgtattttttaagctcgtttggagtgattataaaaataaaccgtgtattatgccatataagaagcctcaatttcccaggaatgaaagcaataacaaattaggttcactcagtataatgcaataaaataagaaattactaataaaatgatagtccctaactcccaaaaaaccgcttgtggttacaaattaaataacatatttctaaatagctattgaattaaaaaaataaaattatgatatatttagaactgaaagacagtgaaaacatgacatttcagatttgtaggatgtagttcaagcagtacttaaaaggactttatagcttaaataaacatagtttattaaacatatagtttattaaatattaggaaacaagaaagataaaaaatgagccaaaaagttggtaaaaagaacacaaagcaaatttcaaggaaacaagatagaaaaataaaggtaagtacagaaagcaatgaaatacagaataataataataacacctgacatgatagagaaggttaaaatcaaaacttgattctttgaaagataagatagacctctgacagactcaaaaagaaagaaaagagaagctaaaaataaaatacaggacaatgctggcacctgtagtcccagctgctttgggaggccgagacaggataattgcttgaacccaggaggctgaggttgcagtgagccgagattgcgcaactactttccatcttgggtgacagagggagactctcaaaaaaaaatttattttaataaaaaatacaggacaatgacaaaaaaggaaatagctgtagaccaaagaaattttcaaatgattttattggaacaaaatgtatacttaataaatttgggggaaaagctaaataaaatgaataaattctcagaaaaaaatataaaatgtaaaaattatcctaagaaatacagaacatgatttcaccaatacatggtaaagaaatggagaaagtagtcaaaagctttcctcccagaaagcacctgagagaattttatggttgagttctactaaactttagaaagttggttcttttatgaactaatccagaaaacagtgaagagagagatgttcagcaattttctgaagttaatgaaacctcgattacagtacctgtgaatgtaacagtgtacattaaaagagtgaaggcaaaaatgcgattatctcaagcagtcactgtttaggagacaaatctggatttccaagcagaaggagatataatataggggatcaggtactttaaaagttgtaagcgttggagaagcagttttgggttgtggggtcggtggtaagatcacatgacaatccaggagacaggaagttgctactactgtcacttttattacttttttttttttttaaacctcacaaggggataactagacactggaatatagctgggcccagcaaacacatctctccagtcttgctttcttccatccgctgtagcaggaaaatggcctctacttcacctccctcttccggaggtcatgataaagcatctaaattgcatccagaaccttagctacaaaggaatctgggaaatatggttgttatctgtcagacctattcaacagagggagattgaaatggagtttgagagatgcactataaagtatgtaccacaaatgctcattacctctgctgctacttaacatagcgttttcattttatgtcctgatcagtgctatccaggaagtaaagcaagaggcatatggatctaaaggaatagataaaattgtcattacttatagaaagtatggtcatcttaacagaatttagtaaactgattactagaactaaagagtacaatgacattactgtgtataaacagtcatctcttggtatctggaggggagtggttctggaacctccctcagataccacaattcacagatgctcaaatccctgacttaaaacagcttagtatttggatataacctgtgcgtattctcctgtgtactttaaatcacatctaggtaacttatacaacttgatataatgtaaatgctatgttaagtagttgttatattgttcagggaataatgacaggaaaaagaagtctgtacatattcagtacaaatgcaattttttccgaatattttccatccacagttgatcagatccatagatgtggaacccacagatgcagaggatgaactgtacatatgatcaaactataagagtcaatttattctagtagtatccaattaaaaatgaataaaaacataagatacgacttacagcaacgaaagcaatataatatctatgaattaataagaatgtataaaaatctcttcagggtagaatttaaaatgctaataaaagaccaagattatctgagtaaatagagtttttattctcttggaggtagtcgtaaaaaggtgtcagttcttcacaaaatatttaaaattaaaccccagcatttttattgtatgtttttgggaacttgataaacttcttcttttttttttttttttttgagatggagtctcgctctgtcgcccaggctggagtgcagtggcgcgatcttggctcactgcaagctccccctcccaggttcacgccattctcctgcctcagcctcctgagtaactgggactacaggcacccgccatcacgcccagctaatttttttgtattttcagtagagacggggtttcactgtgttagccaggatggtctcgatctcctgacctcgtgatctgcctgcctcggcctcccaaagtgctgggattacaggcgtgagccaccacgcccggccgataaacttcttaaaaacataaagcagtagaggaaaattgatccacttgattttatcaccattacagattctgttcaatgaaggtatctgtagacagatgggcagatgacagaatggaaaatgatgtaggtgtatggaatgtccacaacttagattaacaggaaatctttgtctagaactgcaagaaactactgccaaaaaaaaaaaaaaaaagtgattgcaatccaaggagaaaaataagagatatgaccacacacttcacaaaacagtgaacgcaaaaggctaaccagcataggaagaaatcttcaagctcattattaccgagagaaataagaatcgaagcagtaaaatgatatccttattacactagcaagagttggctgaggatggtagatacaagtggggatgtgtgaacataggaattgtcatgcactggtggtgggagtgtagacttggcacctatactggagaacagaagttgctgaattaggcccagaaatactgatcccacatttattttcccgggtacgcatcctaggaacacttttagataattgaataagggatatgcctgaggtatagcatcattaaggcaagctgcccttgtcgtgaagtatttacattgttaggttttttaaaaacactgaggatttggtcacttttcgtgttatctacttaaggagaacagtgctttgatgtttgtttattagctttgcaacctcgacaggtatttatcctccattcctcagcggcttcgtgggttgttgtgagaatgaaatggcttgatacctgcaacaggattagaagtacttgtgagagtaaatgcctagtcagtagcagctattattgtggaattattcctagaagccgaagcactgagttgattggtatggactttccaaaggctcatcttactttgaatatttattgtgtgctactatgtgtcttgacgtttagactaagtggtcaaaaattcttgtcctggtgctagaaaactaccacagtaaatggaaaaaaggtaaatgaggtacatgctagtcattgctaacagatgaagctgcagttggagttaatggtaaatgtgcttaacttttgggttatctgatctgttttaattcttcgtttgtatcattccagaattgtcaggaggagatggtaaacctctgagggttttctttggttcttttttggttcctaattgagacaggctagagggctgtgcctttgatggctgcataacattctacatggttctttctttttattttctattttatttatcttttattcatttatttttcttctaaggcagggtcttgccctgttgcataggctgcagtgcagtggtgcggtcatagctcattgcagcctcgaactcgtgggcccaagtgggctgatcttcccacctcagcctcctgagtagctgggaccacaggtatgcacaaccatgcctggctaattttttgattgtttttttgcagagaccaggtctcactatgttgtccaggctggtctcaaactcctgagctcaagcaatcctcccaccttagcctcacaaagtgctgggattacaggcatgaaccactgtgtccaacctccgtggttctttgaacaatgatcattaagagatttgttgtttgaaccagtgtcattattgataatggataaatgcatttaatatgtagtttaatatgcatttaatttaatatgcatttaataaatgcataacttcatatgcatttaattgtagtcagctactttaggtaactgatatactctaatgtcccagcctccctccagatgaaaataatgttgttcttctcagtgttcccactgctctttttccctctattaccatagtaatcactgttcttctttatattgtggtatatgtatatttttttctcactagattttagtttcttctggccggagaccatgggtgattcacctttgaatccctaaaatgattaacattcaagaagtttttgtcaaattgaattccctccttcccccttggtatcatttgtgctctcttctgggaaatatttaaaatgtctccaaggttattgatcactacattctagaggacctcagaaatggttctcaccagccacccatgttaaagggcagacctgtggcagacagagccattataatttatgactctttctgtggtgacagatagatgtggcctttggtaggctccctgattcaaaatggtttatcctgagctgatgtcatctttgggagtacctgtaatggatctgatcaccggatcccttcaggcaccacacaaattccagcaagttttgcccctagctaggagcatatatttattctacattgctaatagacagaaaatattttcccaaaggaattataggcaatttgctttagtatctttatttactatgcaaataaacatttatttttagtttaagttctctaatttattgccgaatatttagtgtggcatatgttttttttttttttctagtaactcattaccatgagtggttcttgggccttaattttctcatctgaaaaattaacgagtctgtatttttttatatttactcatttaaaatttatatctcgcttagttttaaatgttttaaaaagtgtttaaagttagtgaaaagagtacagagaatacaaaaacaaatactatatccagtaagttagaagcgagaaaaacaaggaaaaacagaagtcggaattcaaacgagaaccagaagtaaggcagatagacaaatgctgagagcctggttcatctgccaggaccgtgcatgatttgagtgatctgctctctagcaactaccagggaaaaggaatcccagtcagtcacctggttcccaaggttcatgagataatctctgagaagtacaactaatcatggtgctgggaggagaaggatatttctcttgagaagtctggaggagagcactgtgattgaatgagcccgaggctctgcacttcacggcccctcaggcctggcagtatttggagatcctctgctgctgaggccagggtgtctgtgcccacggttcatcattggtgtctgctttgcattcttcaaggcaattttcacttccaacgtgatctacagaagtgctcacaagagcagaccctcaggaagtggcagccatgactatagaattattcctggaaatcaaagcactgggttaattggtatggattttttttaaggctcatcttactttgtttgaatatttattgagtgctactaatgtgcttggcttttgttaactttcggaggaaaaatttgacctcaggcttgttagagtctgtcctttgtgacacgcagttggtacgttgtttattttatggttaatgtgtccacttggtgcagcttgtgtttgataaaccaccatctccttttcctctgtctcccagaagttcagagtgtttttctctcactttggccttaggaccattattttctcttaccagtctgttttctttataattctaaatcacacacaccagctccatcatttgagagaggtggggacagaaacaactggctcctacttctctgtgtcaccaccagtgtccagttggtttgggccaagccttggactgcatgtttcctggctttttaagtatcccttgactcaacctttttggcatcaggactggtttcatggaagatagtttttccacagcccagtgggcagggaggtgatgatttggggatgaaactgttcagatcatcaggcattagttagattctcataaggagtgtgcaccctagatccctcacgtgcacagttcacagtagggtttatgcccctatgaaaatcaaacgccgcctctgacctgacgggaggagttgctcaggcagtaatgcttgcttgcccactgctcacctcctgctgtgcagctggttcctaacaggctatggacgggtacccgtccacagcccggagttggggatccctgccttaactaagggatccctttcccccaactcttctctgcatcttgctggatgaggaggtttcccatttactccattactctttcaagaaagtctccaattctgtcttatctggaaatacttcttgttttctaatgataggttaattcataacaacatgatcattaacttatgtcacagtcgcagatggcagtggcccggccatatcctgcagtctcacgtaacgaggcctgtgagagtcggtgtaatttactgcactgatgggtccctaaaggcatttcaggctttgctccacaaagtactctcttttagcacaaattaatgttctttgttttgttcagtgacttttgtcaatatataaatcttagaatttattataatcacagtttgcttgcttacttttcatgcatgcttctttaatccagggtgatttatgtgtttatgcatgaatttttctgtcagaatatgaactgagatatttgcacttaaagtacacacgtttgttttacattttctcacagagctaatactttgttttcccaaaatacatttacttaatgaaattcggatcttcatgttgagatgttcatttttaaaatttgactttagttatgttaaccaagtctgcgttacttaatttaatttggagtcgacttactgaagttgataatttacttaaatgtaatagctgaactgcgtaaattttaaaaacttatcctagctatttgatattaccaatctataaaatcttgattttgatgttgttgttcttactgtagattatctttgttattaagagagcagctttttaatttttaatttttttttgagatggggatcttacattgtcacgcacgtgggggtgcagtggcacaatcacagttcactgtaacctcaaactcctggattcaagtgatcctccagcctcagcctcccaagtagccggaactacaggcccgtaccaccatgcccagctaatttaaaaattttttttgtacagacagggtcttgctgtgttgcccaagctggtcttaaactcctgagctcaagtgatcttcctgccttagcctcccaaagtgtgagattacaggtgtgagccacgacatctggcctgaaagcagccttttgttttacagtttgttctaagggaattcaaagctccacatcttttaacgattattactatttgatctaaaacctttttgaagtaatctgctttgaatcatgtgaggagctcaatgaatataacattcttggtaatcagagaatgggattaaatttttaacttggatggagcagttccagcatgagttatgacgaagtgtctagtgacctgttttctaaatgttgaattaaatctgctatctgtattttaaaagctaatcggtatatttctacctagcccttaaaaagccatcactcatactctctttccatcccatcccatcccttctcttacctaagttacttacttgctatctgctgttaggaaaaattttaaaatccacttattgaacatgtacgtacacaagattacttggctaactatcaatgccaaacagtcagtgaaaggacaccctttaaaataagacttttacatcagcaagaaatgactagtatattttattcaactcaacaaacatccactgggcacttatgttcaaagtactgtgggtgatagaactaataagttagtagtttctacctggaagtaactcacattctttttaaaatttttttggtctgtttctttgtcagacctttagtttgtttaatggaatgtcacaaatttcggtcaagtaaggtgtttttgattgatggcagttctaggcaaaaacgcctcagtgaagatggagagcccatttgggatcaggatcatccagcccctcagagcaagagtatggagatcatattcacagtgggtaccaagacctaggcttggcgtaggcatcacttctgactggggaatttcctataaactgcgcagaccaatgaatgaccacagaggagatagctggcgtgtgcgagaaagagcaaagattaagtgagcccaacataagagtgcctagcaaatcgtctcactgtgtgtgagcccaatgcatggtggcttctattattattattttattctgacgagctttactcagtgaagataggcaactattcagtcatctatttgtcaagtgcctgtaatgtaacaggcgtgatactaggtatagaggatttaacggtgagctaggcaaatccagtcattgccttcacaggactttcacttagcaggggcttcagacaagtgcgtgggctaaacagttgagtaaacgtaaacatggtgaaaaatagagggtgctattgaaatgtattcacctgaagaagggaggaagagattcctggaagaattccattggaagacatgtttcagttgaaaagtaagtaggaattgattagaataggaggtggagagagaggtggacagtgttgcaggcagacggagcatctggggtgaccacccaaaagtgagggacagtgccaggccccaggaactcctttatgcagcccaggcacagccaagtggggcttggtgtgggccctgaccctcagtttgctatgaaaatgtctgggctttatcccagagcagtggggtgctatagttgagttttaaatggggtgcttatctgatgaaatacttaggaagattaccctggtctcagagtggagactgtgctgggagggtggaggaagagtggcagaataaaggcattggtgggacgatggctggagctgagcaagggactgacagtatggcctgcacaggcagaagaacacatgtgattacgcagaggcggggccggtggggccagagagagcctcagggggctgagcagagcacccttctctgctgggccagccttgggatgatttatcagcagaaaactggatggatctgtttgttcaagggcccagggaagacaggctttggggagcccccatcacaggctgaggacaacagatgcagctgccccctgagaaacaacagcctccacgtgtgcacctcgggaagaagtgagtcacagtcttctcagtcacacccagcacctgcttaatggccacttcttccagagccagcctttgaatatgaaaaaacaataatcaaatgatcttcttcccaggagttgagtcggtactcctgattagctcagggccaacactaaaactagaaagctggaggctttctgggagccaggctgcgtggtggctgatgtggccacataacattgtgatttttgacccttccttttctaagtcatgctgagaacccttgaagccccctgctgttcttctgttttccattttctccttccagtactcattaaaaaataaataaataaactgaatgtgtaattaagcactatgttttgtgtcctttttatgacaggttcatcaattctacatgcatttactgaatgcttactaaaggcagggctgtattttacatatcattctttgtgaagctactgttttcacttcggttctgcagataggttgggtgttgaagaatttgtagctgaggatagactttgcctctgcagctatccttcctgatcagactagacatatacctgattttttttttctttttttttttgagatggagcctcactctgtcacctgggctagagtgcagtggcacaatctcggctcactgcaacctccacctcctagattcaagcaattctcctgtctcagcctcccgagcagctgggattgcaggcgcctgccaccatgcccagctaattttttgtatttttagtagagacagggtttcaccatgttggccaggctggtttcgaactcctgacctcatgattcgcccgcctcagcttcccaaagtgctgggattacaggcatgagccaccgtgcccggctcacatacctcatttgaccctgtggtgtgaagttgctattcctactgttgttaactgatggcagaacgtaggtttaaggtaaccaacggggctagcatgcttgttgctgaagtatatgaatgcgggaaaaactcctggcctccccactatgcccttggctctggtcagtgctgggtgcagcgtgcctgccatttgcaaagcaaaacctgtaatcccagtccgcatcattcccctccacgcatacattttatgcagctaaagtagtgtataaagtagctgatggaatactgtactgcctggcttcttgaaatttagaaggaaaacatttcatttaaagttacgaaacaaaccaactactcaaaggcagaaataaggagacagatgatgaaaggtgacagaaacttgactgatatgaccatgttagaattacagaattaagaagagaagtaccaattttacaaattacacgaaaggcattttctctgagttgtagaaagtgagtgtgagctgttgtgtgggagcctcttggtagctgtgaagtacgggtagtcatgtctggagttaccctttctgccccacttccagttgctggaatcatcacagcctcccattcctgtgcagcctaaagaatgcctcctttgcctcttacaagacagattcttacgttgaagttgacatctgccacctgactgccataaccaaataccctagactgggtggtttaaggctgggaaatcagagttcaaagtgccaccagctgagtttctggtgagggctcccttcttggcttttgtaggtggctgccttctttctgtgtcctcacatgcctttgcttggtgcatgcatgtgggaaaagggagacagcacgcatgaattctctggtgtctcttcttgtaagggcaccaattccatcatgagggcccctcccttaggacttcttctaacccttattataatgcctcccaaaggtcctatctccaaaggccatcacatcaggggttagggcatcaaacgaatgaattttggggggacacaaacatcagtccctaagaacatctaatttgatgtttttatttaagctaaaagaatgcattttaacattttcgggttggggtgaggggggacacccacattggctgtagatagtgctttttgctgggttttgatttttcaggatgagggaaaatcgatctagagagaaacaatgaaatttcattaagaacttcaaagggactgtcttcataaaggcaatagatgtgtttagagaaggtttgggggatcaacttataaagagcattcaaactcttcattttttttgttctcccagatttatgggaatgtagtagaaacaggcttcccagtctatcatgtgtcattgaaacgcaaaacacaatagcgtttgtcttgttacaaaccaggaggctgtaaatctattatttattttttattaaaggtgcaagttccagagtgaggctcatgaatagcccagagaaataggagatgaagcctttcatctctgttctgttcttccccatgtgagccaggtcaccagtgattgaatgggctttctgctcttgtgaaatatgtttgtttacctggactatgttcaaaaggtaaagaaacaagaaaagggaaagatgaggaaaatcacaaacctgactttacatttcagatccagtttcaaattgtaattagaaaaagcaacattatttccagctgtcatcagaattttctactagaccaggtgtgctttggatctcttaagggatattataaataatgtagaataataatgctgtgccattcagacttctcttttatgctcatcacccccaaataggctccttggcgtcaccgttgtttacggagtgctgacagtggccacacccaggtgaaagcttctggagttacactgtgtacttctgtgtgactctgagctaggtggggccatctgcaagtgagataagctgtgtgttacctggttagagaaagcctgtgacttcctcaggggagtcgcaggtacacaaaacattgagcaaagaagtccccgtttgcagtggtccagttagagatgtcttgctccttgctatgtttgccttttgaggaactgatctagttcatggctatccagaaaataattggattttttggttgtactttagtaaatctgccagtatctttaatttcctagaaaaatgtaagtcataatatattctgtcatttttctccagtgtaggcaacgttatcgatacccatgtgacttatgcatggtgtgtatgtggctgcattttgcctgtgttgagccacgtgcacaaactaagaagtgtttcttatttgctagaaacaggagcttcagcattttgttcctgatgcttccttgattcaggcagaaggtatttacttgtaaattatatacagtgcatagtctctgcaaagcagaagttggttactatttgccgggactgcttaaacctgccctttagagtagcagtttagtttcctcatagctggtcgggcacctgaagaaatagtagacttttgatgtgtatccttttgcacttcaccacggtggatggacttccatcatttttcatcgatgcccttgtggccaccccctgacatgactccttatgcccaatccaccttgcaaagagaggacagcacacacatcctcctggagcctggccatactggaagatttcgcctgcctctgggccccattctaaatgaaatccacacacactcctccatctggaatcgcagacctactgcaagacccccatagcccacctttttattccctttccttacactactctacaaatcatcacatggtcccagtaacaatgagaatagctaatagcagcgctctgagattggttctgttatttacaccattttacagacaaggaaacagagacttgaaggataggtatccaggccaaggttttacggcctgagcgtcatagcatcagagtggcccatgatgtctgaccatgcaggtcttcactgagacgtgctccctttactgttgcccctggacttcatgggctttcatgccctacaggatggctcttttcatgctcttccctctttcttcattgtttgtgcctccacctcaagggtaaccttctgtgcagtaggtccatgatggaacctccctccaggtaatcctcatggaactcacttttgcttctgctctttattgaacctgttttgtgtcagatactgtgctaggagctgtcaatgtctgttaggttaaattacaaggacataaactgagaactgagcccttgaagtgctgtgaggaaggcattttctgtgttagtaacgagtgcactggcttgcattcagcttttgtatggtcatattgtcccccaaccatgttagaagcttcctgagggcagaaactctaacttcctcatctcctgcattgcctggcagctcctgtcatgtccgtacgccttagaggtgtgcggtgactgcattgctgatgtggtttaaaggaacctggagctcttagagaaatgattagaaggagcaagagctgagagactagtgaaatttattctttccactcaacttacagtgagagaggtggcaatgtttctttcttttcctccttcccttgtttttttgtattcatcttgtatattttctctctctaatttgcattattttttatcaggggaacccacccccaatatttcaacataggttctttctattttccattagcatacaaagagaggaattttacagttgggccgccgggggtgacatcacatatcggtaggaccatgatgcccacctgagccgcaaaaccagcaagttttattaaggatttcattaaggattttattaaggattaaggggagggggtgcaagaacagggagtaggtcacaaagatcacatgcttcaaagggcaaaaaggagaactaagatcacgtgcttctgcggaaacaggacaaggcaaaacagaactactgataagggtctatgttcagctgtgcacgtattgtcttaacaaacatcttaacagaaaacaggattcgagagcagaaaaccagtctgacctcaaatttactagtacagggtttcccaatcctggtaagcctgagagtactgcaggagaccagggtgtatttcagtccttatctcaaccgcataagacagacactcccacagcagccgtttatagaccaccccccaggaatgcaattcttatcttagggtcttaatattccttgctaggaaaagaatttagcaacacctctcctgcttgcacatccgtttataggctctctgcaggaagacaaatacggctctttttgcctcaccccacaggcagtcagaccttatggttgtcttcccttgttccctaaaatcgctgttattctgttctttttcaaggtgcactgatttcatattgttcaaacacacatgttttacaatcattttatacagttaacccaatcaaagtggacctgaggtgacatacatcctcagtttatgaaaataacaggattaagagattaaagtaagacaggtgtaagaaattataagagtattattagggaagtgataaatgtccttgaaatcttcacaatttatgttcctctgccgcggctccagctggtccctccatttggtgtccctgacttcctgcaacaacttttcctatataaagggggcttatgaaagtactatcttctactgaaactattccaataaattgaggaggagggattcctccccaagtcattctataaggcagcatcatcctgatagcaaaacctggcagagatgcagaaaaaaatgactttagccaatatccttgatgaacgttgatggaaatatctgcaacaaaatacctgcaaaccaagtccagcagcacaaaaggactccaccatgatcaggtaggcgttatccctgggatgcaaggttggttcaagatatgcaaatcagtaaatgtgattcattacataaacagaactaaagacaaaaatcacatgattatctcaataggtgcagaaaaggcttttgataaaattcagtatcccttcaagttaaaaactctcaataaactacgtgttgaaggaaaacctcaaaataataagagccatctatgacaaacccatagccaacatcatattgaatgggcaaaagctggaagcattccctttgaaaactggctgaagacaaggatgccctctctcaccaatcctattcaagatagtgttggaagtcttggccagtcctggttgtggaaacaagggaacacttacaccctgtcagttggaatgtaaattaaaccatttggaaagcagtgttgcaattccccaaagaggtaaaaacaggcaaagaaagggcatccaaagagagaggaagtcaaagtatcctttgtttgcaggtgacatgattctacataaaaaaactgggtaaagtctgccacacccagaggtgccttgggtgagtcatcatcttggcccaaagtgttcttcagctgataaacaatttcagcaaagtttcaggatacaaaatcggtgtatgaaaatcattagcattcctatacaccaacaacatccaagctgagagccaagtagggaatgcaatcccattctcaatagccacaaacataatgtaatacctagaagtacagctaaccagggagccaagagatctctacaaggagaattacaaaacactgttcaaagaaatcagagatgacacaaacaaatagaaaaatatttcatagtcatggttaggaagaatcagtatcattaaaatggccataatacccaaagcagtatacagattcaatgctattcctatcaaactacccataacattcttcacaaaactggaaataactattttaaaattcacatggaaccaaaagagagcctgaatagccaaggcaatcctaaacaaaaagagcaaagctggaggcatcatgttacctgacttcaaattatactgcagggctacagtaaccagaacagtatggtacttgtacaaagacagacacatagaacaatggaacagaatagagtacccacagataaggccatcacacctagaaccatctgatctttgacaaagctgacaaaaacaagaaatggggaaaggattccctattcaataaatggtgctgggataactgactaggcatatgcaggggatttttttacaccatgtaaaaaaatcaactcaagatggattaaagacttaaatgtaaaacccaaaactataaaaactctggaagatgggctgggcgtggtggctcacgcctgtaatcccagcattttgggagactgaggcaggcggagcatgaggtcaagagattgagacgatcctggctaacaccgtgaaaccccatttccactaaaaatacaaaaaataggctggatgtggtggtatgcgcctgtagtcccagctactcgggaggctgaggcaggagaatcgcttgaactgaggaggcagaagttgcagatgagccgagattgcaccaccacattccagcctaggttatagggcaagactccatctcaaaaaaaaaaaaaaaaaaaaaaaaaaccaaaacaaaaccctggaagacaatctatgcattaccattctggacataagaactggcgttaattgtatgatgaagatgctgaaaacaattgcaccaaaagcaaaagttgacaaatgggatctaattaaacttaatagcttttgcagagcaaaataaactatcaacagagtatgcagacaatctgtagaataggagaaaatattggctaactatgtatctgacaaaggtatatccagtgtctataaggaacttaaatttacaaaaaaaacctattaatcgaatatgataaatcagtgctatgaactaaacagatgctaatcactattattaattagtgggcaaaggacatgaacagaaacttttcaaaagaagacatatgcagccaacaagcatatgataaaagctcaatatcactgatcactagggaaatgcaaatcaaaactacaatgagatgccatctcacattagtcagaatggttatcattaaaagtcaaaaaataacagatgtgggccaggttgtggggaaaggggagcacttacacaccgttgtggggagggtaaattagttaaaccattgtggaaggcagtgtggtgattcctcaaagagctaaaaacagaactaccattcaacccaggaatcccattaatgggtatatacccaaaggaatgtaaatcgttctacgacaaagacacatatacatggatattcattgcagcagtattcacaatagcaaagacatggagtcaacctaaatgctcatcaatgttagactggataaagaaaatgtggtacatatacacctcagaatactatgcggccatgaaatagaatgagattgtgtcctttgcagggacatgggtgaagctggaggccatcatccttagcaaactaacacaggaacagaaaaccaaatatcacatattctcgtcagtgggagctaaatgatgagaacacatggccacatagaggggaacagacaccggggcctacttgagggtggaagcctccctcaggtaggcctgtctcaggtagatctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctccctcaggtaggcctgtctcaggtaggtctgtctcaggtaggtctccctcaggtaggtctgtctcaggtaggtctccctcaggtaggtctgcctcaggtaggtctccctcaggtaggtctgtctcaggtaggtctccctcaggtaggtctgtctcaggtaggtctgtctcaggtaggtctccctcaggtaggtctgtctcaggtaggtctgtctcaggtaggtctccctcaggtaggtctccctcaggtaggtctgtctcaggtaggtctgtctcaggtaggtctccctcaggtaggtctgtctcaggtaggtctccctcaggtaggcctccactctcaagtaggccccagtgtctgctgtggagggtggagggtgggaggagggaaatgataagaaaattaactattgggtactaggctttgtacctgggtgacaaagtaatctatgtaatgaaccctcgtgacatgagcttacataacaaacctgcacatgtagccctgaacctaaactaaagtaaaaaaaaaaaaaaaaaaaaaaaaaaggtaccatcagggctagtctgagacttcagggacttaattcctcattgtaattttgcaaataaaggaaatagagttccctttcacgttctccaggctcttcagcctttagtcttccccagcaacccctacctgctgttttccaactcagagcgtggcaacaactttatcattaagacctcagagatgctgagtggaagagaagtgtgtgtaggaaaaggggggcagataaccaagcaatcgtataggtaatgatcatgcatctagaactccgaagtgtgctgcagagtgcattcccaagtccttccttctgtgacccaggtctagtcctaaatgcagagggcaggggtagggatgggagtaaaagcatttggacaaggaaactgatgttggagaccggaggtatcggtgtcaacactctgcaggcctccagctggttcctgcgtgtaggccatgcagcagctcgaccttgtttacagctctcgggctaatgaggattatcatttatgcctgagagtatgtaaatttggcagttcctgctctaaaataacattctccatctttccgggagtaaactgctttcttagtaaacaaattttcagtgcattatgttaccatttagaaactttcctcttccggtgccaaattgctcttaaaggtgagtgattcataaaggatattttatttaccttgaactcagcttctgtttggaacagtattagaacacaaggagagtcagtaaaccatcgctggaaatatgtgaggagctaagacattggaatccacatctgtatttagatcttgagaggttgcatctgtctagttcatagcactgatttctttatcattcactgagtaactagtaagtacaaaaccctctacttggggagttccttgagatacagaaatgaataacatatcagtctctggcatctgtgcttctacactttggagagggaaataaaacaagtagtaagaggcaggagtcccaggtgccccctgagaggcatggcatgccacagaaggcattggcaggaagactgcgtccacctgcttgcagggtcctgtgaatgccaccgagagggcggcatctgcaacagtagaatttatttcactggagaaagaaggtggcaggcatttcaagtggagggaacaataagagcagaagaaagcatgggactttgtggagcacagagaggccttgtttgcttggagtgaaggtcccgtatcagcagaccaggaaggaataaggctggaaccccagtttggggtcagactccaccccaagtccacaccattctgggagggaacggaatgccaatctaaggtgccagggagaagtgtttgaagtttgtacagcaggggaaagacatcgatttgaatactttttcccttagtatgtttttgcaaacctattttggggtattgtaaaaagattctgtgcttatatgaatttgggaataaacaggtgcttgctgtaaggcttcttagggcccttaatatgctttgtgactgtaggaggggatatgttgtgtcatctccaaacgtatttgaccatgagatctatttgaatacaaacctaatgcacctctttggatttccttggcttcctcctccttgcctggcgttccctgtctagtttcacgtgaaaccccatcccttcaagccccacatgacccttcattctggaccttattctgattgagctttcacttcgtttctggacttggataaaatgctgcaaacagggttgctaagcggccaccaagggctgcctggccccacctgaagtcccctgtggggccgctccttgagagttgaacctttatcaatgggaaccaggaaggatcctggccaggtgctttcccattctttgttgttccacggactgctccaaggtatgctggcttctgagagaactttccagagaagtcgcacgtgcttgggcgtgtccgctgagtgagctggtgtgtttttgggtctgtgcccttgctgaaattggggtgacccatgacttcacgttattttttttttttgagatggagtctcgctgtcccccaggctggagtgcagtggcgcgatctgggctcacttcaagctccgcctcccgggttcacgccgttctgctgcctcagcctcccgagtagctgggactacaggtgcctgccatcacacctggctaatttttttgtatttttagcggagacggagtttcaccgtgttagccaggatggtcccgatctcctgacctcgtaatctgccctcctcggcctcccaaagtgctgggattacagacgtgagccaccgcgcccagccaacttcacgttttgagtgatccactgcctcacatttttccttgcttcctgtgcctgtttccctacatcctgctgccctagttttgtacttccgaaataaaacatcagcatgtaatccttgcctcagcctctgctttccagaggacctgagcaaagatagactctgactgagtgctagagacgggtgtttcacagactcactttggaaaatggctacgtaggctgaactcagacattgagctttaagagtggctggttttgtaatagaccagacaagaaataaaataaggagaggaaacaggtagttgatgaagtgaatcagaacttgtaataaagctagagtaatggatttaagagtaggtctcatagagataattgatgaaagaatgagcgtataggctgcataagttgaggggataggtagaaaaaagagatgacaacattaagcatggaaagagagagaaggaggcgctcttgataaaggactgatggtagctggaggagtggagtgccagggcacaaagctgcaagagccctgaagaggaagaggaagagggtcatgaagaaggaaattgatcagggtcctggattcctgaggtacatggtcagtggtaacagagaacagagggggcatacagcaggtgtgctgaggtggctctgagagacgggagtttggtaggggagggaagaagggtggttgctagacagtacatcaggattgagcacagcataagagatgaaacgggggagaaatctaaagacaggtgtgccacttttgcctctaaacatgtggtataatttttgtcagcgaggaaataaatctgtttctcttttccattttccaagaagggagggaaagagattagaagtaagactgacatctcagggcctctaccatttctttgttgctaaaggagacacagtatgtggctctttgtttcagcaaaacactaatcagctttcggatatgcaaatatgggctgcagagctgattgagtggaagagagctacattgctgtgctaagtaaaggaagaggaattgcctttgatggtggggctggcccaggagagaagcagggaggtgtgtagagtcgctgggggagagagcgctgagggcttcaccattgcctaactctcagtgaagtgtgccacacccagaggtgccttgggtgagtgtcttggtggaaaggaagagaggtaggatttaagtcatacaaaatgggctaagttactgggtcaacatagacctccgaaagagcccgccctaggccaggagtcatgagtgggaggaagtgcacccagtggaggtgaccttgagaatgtgtttcttaggaattcacagcaaattgaggagggctcgagaccccccatgatatatagaaatagaggacagggccgggcgcggtggctcacgcctgtaatcccagcactttgggaggccgaggtgggtggatcacgaggtcaggagatcgagaccatcctggctaacaccgtgaaaccctgtctctacaaaaaatacaaaaaaaaaaaaaattagctgggcattgtggcgggcgcctgtagtcctagctactcgggaggctgaggcaggagaatggcatgaacccgggaggtggaggttgcagtgagctgagatcgtgccactgcactccagcctgggcgactgagcaagactccgtctcaaaaaaaaaaaaaaaaaagaaatagaggacagaagcaattttgttacagtgtctaaggacagagtagccttaactgtcatctgggtatcatgtgggatgtctttatgttttgggggcaaggggaaagcactcactgaagacagaagctgccacttgagcagggaggtgacatgtgctggagctgttgtgagagccagcgtattaagggttctgtaagagatttttttggtaagcgttgagagtgcatacagagtgagcaggcattgtggtgaagcagacagcatagtgctaacttgaggtggaggaggaggaggaaggaccctgggcacagtgcagacatctgggctttgggctgaggccctgtcagagagtgattcttgggcatgtgtgaaaacctttgttgaaagggtccagaaacaatggctaagtcctaacagaactctgctgtggacctagggaaaaggaaagaactaagaatttagcggtcaatttgaggccaaagacagaggagaaattgagggtcagaggggatttagagtttgagattttaaacatttgctgtttgtattagtcaagattctccagagaaacagaacgtgtgtgtgtgtgtgtgtgtgtgtgtgtctaaagagatttattagaaggtgttggcttacgtgattatggaggctgagaaggcccatgatctatcagctgcaaagtggagacccaggcaagctggtggtgtagttcaggagtgttagagccagagagccaagggtacaggttccagtatgagtctaaaggcctaagaaccaggagtgccaagtacaggagaagattgatgtccccgactgagctgtcaagaagagagaaggcagtgtgaatccaactttcctccgctttttcagcccccaatggactggacgatccctacctacatcggggatggccgtctgttttactcagttcaccaattcagatgctgatcttctccggaaataccttcacagacacacccaggaatgatgtttaattaagtatctgggcaccccgtggcccactcaagttgacaaaagtacactgccccttggcctttcctgagtgttatctagctttccatgggtagacatcagctctccacatctaaattgtaagctgctccagggcaggggccagatcttctcctgtgtgttctcagtagctgacacaattgccttccatgtactaaatgttcagtaaacatgtgttggatggttcattgatccaatagacttatgtctatgccaatacaggcttgctcttgaaaagctgcgggtaaatcaattctttgtaaattgaatcttatttcaaatgtagtagggatgttcagcatttcaaggaatcctaggtcaatctttggtggatctacgagccctgtattctgccattctcgttttacaggtaagggagctgagttacagagaaattaagtgacttattataatctgatttgtcagtcaaatataaggtttcttcaagcaaaacatacctgttacttaggtcaagagggatttggtgaaaagcctagctatgaaatttataacatcagattaataacgttatattttcagaagcatttatttttagtctgcagatatttattaagtttgtttacaacagtcttttagttgtatactaatgagtaaaggctatgctaaattgtgttgcagtttatgtcagattagaaacaaaaaacaacagacacaaagtttctggttcagaaaattcacctctgaaagcccccagctcgaagtgtttagtttttcttctgtgaggtgtgagaggatgttgaatgtgctggacaggtgccaggtcctgcgatcctgcagggtgcgttcctagattcattgttgaggtgatgaaagtctcttcagtcagtggcttaatgttaagtgtgagaaagatgttggaaaagatttagggagaccttttgggcacctcactgatggaattattttaaattgagcaggttttatcaacatctgtattgggttgatttagtttctccttgctatcagttctagaataaaatagtttattatatgtgagaaaattgataaaagtgtaaagctactttgcatcactactttggatgatccaaataaaggaaataaaagaatcaaagcattggatttactctgctttcctttctcttcatagtcatttttatgtgttttggcttatcaaaaatgagatcaaagttgttatatactacaaaagaagctgcttttttatttaggattttagtatcttgacatggagcagtgaatcagatgtggggacaggagataatttgtattcatattagatcaatattagctaacagctgttttacggacatcaagtcaattctgcaactcagcagggagaaattattaccccctttttagagatttggaaactgacttcacagttaatgtgggccttttgacgtcagtactgatctcacagttggcgtggagcttttgacgttggtactgatctcacagttggtgcggactctttgatgtcagtactgatctcacaggtggtgttggccttttgacgtcagtactggtctcacagttggcgtgggcctgttgacgtcagtactgatctcccagttgtcatgggccttttgacatcagtacttatttcacaggtggtgtgggtcttttgatgtcagtgcacagactcttcccgtgcaccagcaccacctccatggcgcctccccatgtcttttaggttttgcgtatattactattggctgctgtgagcaccatttttggaagtacattttcatattgcatgaagaaatacctgagactgggtaatttataaagaaaagaagtttaatggactcatagttccacatggctggggaggcctcacaatcatggtggaaggcaaaggaggagtacagacacgtcttaaatggaggcaggcaagagagcatgtgcagaggaactgccctttataaaaccatcagatctttgaggactcactgtcatgagaacagcatgggaaaaaaccacccccatgattcgattgcctcccactgggtccctcatgacacatggggattatgggagctgcaattcaagatgagatttgggtggggacacagacaaaccatatcagaagacagttataatatttgcataatacccagactgtgaggaataagccaagtaataagcaataacagatggaatattgaggttatgcagagtctgtgctgtgcatgtcacagcctgcacttgacctgagtcatgtgcttcctgagctctttacagggtgctaggccaggatatacgtgagagttacagtgattggaaaattagttttcctattagtgtaaatacgtatgtgttaggggatagatgatacactattacagacttataaaatggaaaactaaaattggaatgtaaagcttatagcaggtagcctcaggctgtgctcccaaacctttgggttcagtttctttatgtttcttcagttttctgttacggatactggagcagaagttgaattttagtggatttgatgtaaagaaatgggtatatttcaactttcacctcctttcctgttcctttttttttttttttttttttgctttgaagtgtgaatgaataatactatagacaaaatacaatagcaaagacaaattatggataaattggaaaatcaaactctgcagaacaaagattttttagttttacatcatgtaacaaatttaatgacaaactataccaacaagtgaattgacgatttaagatatttcatttagcttccaaaatgtgaatgctaataagtttgaaatcactaaatcacagtaattccttgcattgggcaacagaaatctattaattaaaatgaaaagtctaaagatattttggggaagattgcaaatttcaaataactgtatgtggtatcctccagttccttttaatagtctcatccttagctgcgcatttacttcacaagggaaaccttaaaaatactgataacagagcctcactgctggacctttagatttaatgggtctgcagtgagggctgagtatagcacttttttttttttttttttttttaaggcctggtcttgctctgtcccccaggctggagtgcagtggcatgatcgtagattactgtggccttgacctcccaggctcaagcgatcctcctgcctcagcttcccaagtagctgagactactggcatgtgccaccacacgtggctaatttttgtattttttgcagacatggagttttgccatgttgcccaggctggtagagcattttaaaaaactccccaggagatcctaatgtgcaaagttaagaacaacggtttatatgataatcattctttaatcatattatttgtttaaaggtagattcctgtattttaacattttaactttaaggttgtgatactctgatgaaggcagctcctatcaacctgtaggcagttcaaggtgttaacctttatctttaatgtttttatgtgtcagatggcagttagtataaggattacctttttccttttgcagtgtcataatactgagtgccaggacctaagtttttgaaacctcccagtagcccctttttaaactgctctgagcctgcagggcacagcatgacctagctgttaatttagtactttcatctgattgacctgggaaggatcactggccgcctaggggagaccttcccattattaattcctgcctggatgtcctttatgtgtctgcacagaggtttcggctttggccacgttgtgaaagtcataaaattaaagaaatattttgcactggctgttcacattgacattcagaaaaacaaattgcagtaatcactggggcctcttcctttgaaagaacatgcgaccagtgcctttttagtttatatcttggtagatttgcagtgggtctgctgtacgttgatgggtgggaagtgttaatgatcactgtgggcccatggccgctggaagctatttgtattctttgcactcgtgtggggcatgtgtgtatatgtgcagaggtgttcatatattgcttttgtttgcattttaaacatgaagctcatttttaaagtacttgcaaaatttatccaatgggaggcaaacctttaaattagtgattctcaaactttgagtgcataaggatcagatacagggaacctggggtggtgtctgaagtttgagaggactggggtcaataaatttccacaaaaggtgacttctcttagatgcccggatacagatgacaaacaaggctacagatagttctatacagaaacaaatgaatatatttttaccatttgtggaaattacagttttgaaactgggaagccctttgtatcactatcagctctatttttggaagtaatggaggaagtatttcaacctgattactgcctgtggagtgaggaatttcttagtgtttgactgaccgcctgctgatactttatttctttagagctcctcaagtcattataagaatcacccaacagtgtgaaatcaaaatgatttcttactataaaatgtcagctatctatcgtaaaagattatgtgccatttaaaaatataattgccgtttctcccctctcccccaccttacattcagatgttccagaataacagaatccctgcaaaatgagaaggaatccctgcaaaatgcaaggatctagcctgtgcaaatttcagaaaccgccttctactttaagtcttttaatagtccagataattatcactctgctcactgcccttttctttctctctacctcctcgtcattcttgcgacattttaatgatgctgtttgtgtattgctgctgatgaattctgcccagtgaaggttatttatttatttttccctgagctggattttaccctctgtttacttatgttggtgttctgtttcctttcctaactgctaccagacattcgtttccatgcctttgtataatgcacagcaggctgatgaagcgtggggactcgcgctgtgggaatcctgcttgggtaaatgtcaccgctttatataaagaactttgctctatcgtagctccagaatctgctcagattgccacaccttaacatatgatctgattattaggaagtatatgtttgttgtgttttgaaacactgatgggtttttaatgcactgctgattaatatgtgaaagtgaaaaccagccagtgaataacctggagtccttgtcctcctgccctctgcaggcttgcagggcattgggcagctgggacttgtacctaggacaagattacccatctgtggaaacgcattgctgacacctggacaaaacgagtgttgcaagtggaaatcagtggagatgcagaagagaattttgcctctgtcctgctaatggggaacatatttaacttggtgcagtatctgcagtaagctagtgtgttaggtactatttgaaggagtcttactcatcatcaagttaatttcttgactttaagaacgtatttatgcagcagcccttttctcagcacctctggacttttgaaaagtggccttttgtcttatttctacatagaagcactgcccctgtgcttccctttctggtgtagggcgcatggagcactggggacaaggtggggctgtttctcaaatctcctgcccccaggtctggggatagtatgtgatgcacatgagcttcaccatgcatcagctgccccgttctccaaacctagctttactcaaagaccttggtggtttggaagtgctcagctcatctttgtatacttctacttgttttggaacatcattcctttgaagaaaactttgaagacagcttctcaagatgtttgtctttcctattgccgtactgcattgactagcctcagctaaggacctggactaaaagataggcacccatgcttactggggaacctcttgagtctttaagaatgtatatgcaagcttcaatcaactgatggatgattcccctccaatctcccttcccttcctcctgctcactggccactggcgacacccccaaacaaaaagctgtgtatacgcaagagggcatatggcacagtgggtgagaacgtaagctcttgagacaggttccgggttctggctttgccacttcgcagctcttttctctttctgaacccctgtgtgcccgttttctcatttgtaaaagaatgaagataatagcacttaccatgcctagcataaactgttgtttcctaaatatatcattttaacaactttattgatatataatttacagccatagggttcaccattttaaagtgtgtaattcatgatttttaacatgtttagggagttgtgcaaccatcatcataatctaattttagaacatccccaaaagaaaccatgtacctactaggagtcactctctatctcctcctgcctctctgccctgcttccctatttcccaggtaatcactcacctactttgtatagatttgcctactagggacatttatattaatgtaatcatacatagacggtttttgtcactgacttgtttcactcaacatagtgttttcaaggctcatccatgttgcaacatgtgtcaacacccaaattcctttttattgcagattaataaagtgtgtggatataccacatattgcttatccatttatcagttgatagacatttggattgtttctgctttttggctatcatgaataatgctgctatgagcattgataatacaagtttttgtgtggatgtatgttttcgtttctcttgagtatatacctaaggatggaattactgggtcgtatggtaacttgatacctaacattttgagagaccgccaaaccatttccattttacattgccgccggtcatgtatgagggttctgatttctccacatccttgccaacacttgtaattgtttgtctttttgattctagtcactttactgggtggtttgggtgggttacctcattaattgtgactttgattttaattttcccagtgactaatgacattgaacatttttcctgtgcttattagtctaaatatactattgattgtaagaaaaattgcttactgttttagagataatactgatataagaaccatcagtccctgctttcattagaggggcaagagtgaggatagttttaaaatcaagcatacttaaagaatcatacctgcatctcattaaaagaaaatgttatttctaggtaaagctaaatcatcattaatgtatagggtttactgtttttctagtaggtttatgtgtagagcactcattttgtttggtttaatctctagttgcttttatgttttaatttaacaaaaatgggtgattggaaagatggaaaatacccttgttgccaccacagtgagttccaatttgatttcagcaacgcgtagaagattgaagtcagatgcagccaattttctcccgattactttttttttgaatcttgcctgaataatgtgagctttttcagctagctaattaacactgtttttttctgccatattggtgactttatgatattttgcttgtaattatatatatattcatttatatacttctaccctattcgtaactttatgatattttgcttgtaaaaaattatatataaattcatttatatacttctaccctatttattaaatgtcccctgcatgaaatatatattaatagctactgcatggattatctttgattgcttttctaataacagttatctggactttgcttggtcttgggtaagaggcatatttgtatgtatattttctcatttttgaaacagaaacataaactgttgcctccgatatatttaataaaactcaccagcactactgataatatttaattatgcagttataattctattcatttttagtttacattctgaatcttaggggcagtgaggcagagtgacatgatcatggaagtatttgtaccacaggggtttgaccttgactctgccacttcctgcgtgactttgaactagtcaaagttaccagttcaaagttagactttgaacgagtctaattgttagagaatggcatgaacccgggaggcggagcttgcagtgagcccagatagtgccactgcactccagcctggtcgacagagttaagacttcatctcaaaaaaaaaaaaaaaaaaaaaaaaaaaacaacaacaaaaaaggaggttacagtctgtttatgttgtctagttactagtcaacactaaccactctggctcggtgttttaacctgtctaatgggtattttttttttttttttaagtcataccatctacctgatgcggtcgttgtgagaacatttcagatagtatttattaaaatatttcctccttggtatgaagtagatgctcaataattgttaggtagcacagattaattatcctttatctaaaaattccaaatctgaaatgctccagtgagcatttcctttgttggtgctcaaaaagttccgcattttggagcgtttcagtctgtcgttccaggggtagtaacagaagctgtcatcttgctggctcttccatctggctgggttgcatgagagttaaacagtaataggagaaatgaaatttcagtaataggcagtctccttagcacaataattggtacaagagagtaagtctgacagtgccagtgaccatcagaacaaaccacagtcattgtggtaaagttgctcgaggcagtgactgaggaaagtgtgtctccatttctgtaacaatgggtagatgtctgctctaaggatttttaattgaggtaaaatgtacagaaagcatgaaaagaatttcatagatgttaagtgcataagccggtaagttttgacaaacgcatggactttgtgaccacctcctcactccagatgaacgtctccatcacccctgcaagttccctcaggcccttccaattaatctccatccctgtaggcagtcgtttttctgatttcttttcaaatagataaatattacctgtgcttgaatttcatatgaaggaaatcaaaatgttaaaagaagaacttcagacaaaggaaatttagcagagtttaattgagcgaagactaattctggaatcagaagcccccaggctagcctaagttcagagtaactcatgctgccacatcatcagataacacttatgaacagaaaaaggaaagcaccataaaagatagaagtgaggtacaggtacagaaacagctagattggttacagcttagcgtctgccttacttgaacacagtttgaacactggccgcctgtgattggccaaaactggtataagagtaggttacaggctgagcgaggtgactcacacctgtaaccccagcactttgggaggccgaggcaggcggatcatgaggtcaggagatcgaaaccatcctggctaacacggtgaaaccctgtctctactaaaaatacacaaaaaattagccggatgtggtggcgggtgcctgtagtcccagctactcaggaggccgaggcaggagaatggcgtgaacccgggaggcggagcttgcagtgagcccagatcgcgccactgcactccagcctggtcgacagagtaagacttggtctcaaaaaaaaaaaaaaaaaaaaagaggatgttacagtctgtttatgttatctagttacagttcactttgtactgagaaaacttctccccttttggtcaacttctccattttcacatcactctttcagtgtcataaagagactgaaacctcaaatcccactgggaaatagcagaacagtgggttttgtaagatagaaacaggacacagaacaccggcggcggggaggccacctgttggttacttcaggttgctttttcgaaagtgttagagagaacttccttattatgctggagtgtcccattttaggaggaaaataacctgctctgttttgagattgatctgtttccttacagtcttagtttgattaggtcgcatttagctcagtgacttcattttggtttggtctggtctgtcggggcctaggggagaggggctcagtgcagtgcaatggcctcccataattttgttggacaatacagtacagacagttttgtttttgacttttttcacccatcaaaatgtctgtgagattcctcgatggtgctgagtttaccagtttgtttctttttattgatgtacgtctctgtcgttttccatgtagggcactataaataacagtactttgaccgtttataaaaaattactcgtgtggatgtatgctttttttcctcttgggggaaatatccaggcctggaacttctggatcattgtgtaggtatttaattttatgataaattgtaaagcctttttctaaagtggttgtaccatttttacatgttcaccagtaatgtatgagttgcagttgctacacctatttgcctacatttagtgttgtttgtattattcaatttagccacttatagtttctgatgtcaaatgatgttgagcagcttcccatgtgctcgtgggctgtttgtagatcttcctttaggaagtgcatgttcaagccttttgctcattttatttatatatttccatttgtcttttctatcattgatgagtaggcattctttatagactctggatataaattcttgcaagatatgcattatcagaatattttctcttactctgtggctttcttattcaactcaacagtgtgtttgttctaaattaagctttttatttttattttattttgagatcattgtagactcaaatgcaattgttagaagtaatacacagagatcccgtgtacccatgtagactctcccaatggtaacatgttacaaaagtataatacggtattacagccaggacaccagcatcagggcagtcaagaccagaatatttctgtcagcacaagatccctgcattgccctttaattgtcacaccttcctcatttcccttgtccccatccctggccctggcaaaccctaatcccttctctatttctatacttttgtcatttcaagaatattatataaaaggaatcacactgtgtgtgaccttttgggatcacatttttgtcactcagcaaaattcactgcaaatttatggaggttactgcaggtatcaatagtttgttccattttattagtgagtagtaaaccgtggtgtggacatataacagtttgtataccattcaccttttgaaggacgtgggctgtatttagcttttggctgtcatgactaaagctgttacctaggaaggtttctgtgtgaacatatgtcttcatttctttgggataaatgcccaagagaacagttgctgggttgcatggtagttgcatgcttgcttttatcagaaaccaccagtctggtttccagagtgtctatagtactctgtgtagccaccagcaatgtgggactaatccacctttttttttttttttttttttttttacatcctcaccggcatctggcgttctcgctgttttttactgtagccattccgatagatgtgcagtgatatctcatggtggtttaatttgcgattctctaatcgttaatgatattgaacatcttttcatgtgctgatttgccatctgtagattctctttagtgaaatgtctgtttatatcttttgctcattttctatttggattgtttgtttcctgctactgatttctgcggattctttgtatattctagatgctagttctttttcagataatgtggtttgcctgtattttctcctaatctgtgtctgtcttctcatctctccgtagagtcttttgaagagcagaaggttttaatattgataaggtttaatttgtcatttttcttttgtgcattatgctttttatgtcaggtctaagagtctttgcctggccccacattacaaatattttctcccatttttttgaaatgttttatggttctacgtttaagttcctggtccattttgatttaatttgtatagaaggtgtgaagattaggtaaatgtttgattttttgccttctaggtattcaattgcctagcatcatttgtttaaaagtctgtccctcctccactgaatttttcacttttctcaaaagtcagttggctgccttgtgttgagtgtttgccagctctctattttatgtctttgatccctctatgaataccatactgtccttattactgtagctagatagtaactttgaaatcaggaagagtgattcctcatattattttgtaaaattgttttagatattctacttccttttttcatataaagcttagaataatcttgtatatatctataattaaatatgctggtatttggacaataattccattacacctgtgtgtctggttgcatagattttacatttttactatgttgagtctttaattctatggacatggtgtgtctcctcatttaattcagtctttttgatttctgttaccagcattttataattttcagcatacaggtcataatttctaaagtttatacctaagtatatcattctctttggagtgattgtaaatggtattatgtgtttcattttggtttctaaatgttcatcgtttatagaaatgtgattgattttgtgtgttgatcttgtatcatgtgaccttgttaaacacattagttctagaagggctgtgtgagtgtgagtgtttagcttctttgggatttcctacatagacagtaacatcatctacaaataataacaattttagttctttccttccagtatgtacatcttttatttatttttattcagtggcgagaccttcctatactatgttgaataggagtgatgagagcagacatccttgattcattaccaagtttacggaaaaatcgttttgtctttaactgtgttaagtgtgatattagatgtagtttttttttttttttttttttgagatggagtctcgccctgttgcctaggctggagtgcagcggcgcaatcttggcttactgcaagctcccgggttcacgccattctcctacctcagcctcccatgtagctgggactacaggcacccaccaccacgcccggttaattttttgtatttttagtagagacagggtttcaccgtgttagccaggatggtctcgatctcctgacctcatgatccggccatctcggcctcccaaagtgctggaattacaggcattagccaccgtgcctggccaatgtaggtttttaaaaattgatttttaaataagattgacagaactcctctctattcctaattcggtgaatagtttttaagatcatgaatgttgtattttgtcaaatgctttttctgcctcaattgatagctcacctaatttttttccttatcccattgatgtggtagattctttctttttttgttttttgaatgttgaaccagccttacatacctagaagatactctacttagttgcatatacgttattttaatacattactggatttcatttgctaatattttgttgaagatttttgggtctaagtttatgagagatactggtctatagtttacttttttgtatttgtcaagattttatatcaaggtagtaatagtcttcaagaaatgaattgggagatgtttctttctctactgttttctggacaaaattatgtacattggtgttgattcttctttaaatgtttggtagaattctccagtgaaatcaactgggtctggagaatttttattgagaagcttttaaattataaattcaatttctttaattgcttatgggactatttggactattaatatttcattttggctgaattttagtagtttgtagttttctaggaatgggtttctatcttctaagctgttaaatttgtgagcttaaagttgttcatagtattctttttttaatgacttcaatatctgcagtgataccattgttggtgttgatgatttgtgtcttctctctttttatttattttagtcttgctagaggtttatcagtttttttctcaaagatccagctttcttatcaatttatttatttatttaaattttattttattattatactttaagttttagggtacatgtgcacaacgtgcaggtttgttacatatgtatacatgtgccatgttggtgtgctgcacccattaactcgtcatttagcattaggtatatctcctaatgctatccctccccccttcccccaccccacaacagtccccagtgtgtgatgttccccttcctgtgtccatgtgttatcattgttcaattcccacctatgaatgagaacatggggtgtttggttttttgtccttgtgatattttgctgagaatgatggtttccagtttcatccatgtctctacaaaggacatgaactcatccttttttatggctgcatagtattccatggagtatatgtgccacattttcttaatccagtctatcgttgttggacatttaggttggttccaagtctttgctgttgtgaatagtgctacaataaacatacgtgtgcatgtgtctttatagcacaatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgctattctaactggtgtgagatggtatctcatagtggttttgatttgcatttatctgatggccagtgatgaggagcattttttcatgtcttttggctgcataaatgtcttcttttgagacgtgtctgttcatatgcttcgcccactttttgatggggttgtttgtttttttcttgtaaatttgtttgagttcattgtagattctggatattagccctttgttagatgagtaggttgcaaaaattttctcccattgtgtaggttccctgttcactctgatgttagtttcttttgctgtgcagaagctctttagtttaattagatcccatttgtcaattttggcttttgttgccattgcttttggtgttttagacatgaagtccttgcctgtgcctatgtcctcaatggtattgcctaggttttcttctagggtttttatagttttaggtctaacatttaagtctttaatccatcttgaattaatttttgtataaggtgtaaggaagggaatccagtttcagctttctacatatggctagccagttttcccagcaccatttattaaatagggaatcctttccccattgcttgtttttctcaggtttgtcaaagatcagatagttgtagatatacatgcagcattatttctgagggctctgttctgttccattgatctatatctctgttttggtaccagtgccatgctgttttggttactgtagccttgtagtatagtttgaagtcaggtagcgtgatgcctccagctttgttcttttggcttaggattgacttggcgatgcgggctcttttttggttccagatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaaggtggattcctaggtattttattctctttgaaggaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcgtctgcaaacagggacaatttgacttccttttttcataattgaataccctttgtttccttctcctgcctgattgccctggccagaacttccaacactatgttgaataggagtgctgagagagggcatccctgtcttgtgcccgtttttaaagggaatgcttctagtttttgcgcattcagtatgatattggctgtgggtttgccatagatagctcttattattttgagatacgtcccatcaatacctaatttattgagagttttaacatgaatggttgttgaattttgtcaaaggccttttctgcatctattgagataatcatgtggtttttgtctttggttctgtttatatgctggattacctttattgatttgcgtatgttgaaccagccttgcatcccagggatgaagcccacttgatcatggtggataagctttttgatgtgctgctggatttcggtttgccagtattttattgaggatttttgcatcgatgttcatcaaggctattggtctaaaattctcttttttggttgtgtctctgccaggctttggtatcaggatgatgttggcctcataaaatgagttagagaggattccttctttttctattgattggaatagtttcagaaggattggtaccagctcctctttgtacctctggtagaattcggctgtgaatccatctggtccttgtattacttttctctgtccctttttactgattctgctcttacctttattattttcttccttaaatttattttcactttccttcttttgaggtaggaaggtgggttattgacttcaggctttccctctttctaatgtaagcattttagtgctatacattttcctctcaacacttctttagctgcatctcacacatattttgatatgctgtattttcattgttttgtatattttcattgttttatttattttttatttaattccagactttttctttttcttttcttttctttttttttttttttttgagacagagttttgctcttgttgcccaggctggagtgcaatggtgtgatcttggctcactgcaacctctacctcctgggttcaagtgattctgctgcctcagcctccagagtagctgggattacaggcatgtgtcactacggcaggctaattttgtatttttaggtgagacagggtttctccatgttggtcaggctggtcttgaactcccaacttctggtgatctgcccacctcggcctcccaaagtgctaggattacaggcatgagccacggtgtccagccccaaacattttttctctgacttgtttatttttaaaaattctgtcattcagtttccaggtctttggagatattcctgttgtcttttggtttttgttttctagttttattctgttaatactatggccagaggatacactctgtataaatttagttcttttaattttttttaggtttgtttactagtctaggatgttttctatcttgattaatgctctatagcacttgaggaaaaaaaaaacaagaaacacacacacacacacacactaggtgtgatgtctactgtataatgtaattgttttccaccttgtggttttggcatttgaaagaacagttaaataatccaaagggatatattgtggaattttaggctgtcaggaagtttttactgtataattctatctgtaaggagaaagcatacgtagctcagtgcttattagattgttttatggtttgaagaaataatgtttcacttaaggaaaaatattctcaaggaaaaaatgcccacagtcgtcagtgaactgctgagtctcatctacttcattgctcaggcatgtaagaccttcctgtttactaataatgttgacttttccttcttattgggaaggaagctaaagaacagcttgatggtttaaaatgatgcacctaaattattgattccattatatatttaggcagtacatttttctctcttgaataatagaaatgtcacctactatttaattttcctttttttttccagagtaattttcactatgtctgattacataattagatttgggataccaactgggtatacttggtaagaaaatgagaattaaaatgtttcagagtaaaattatttcagagcttttgcaaatctttattttagataaggtgatttctatttttaggtttgtttttgaaatagtctaggacatttaaattttaacttctgatcaaattaagttgttttggttcatttaatttgtatgtttcatgtctttgacaaaagttttttttttaattgatgattttttaagataaaatttatgatttggaatgatccaattatctaattccagatgttacttttgaaagatattaatttctaaggtgttaattttgcatttttgtgaaaataacatacacttcatgaatctaactgctaatttaacagctctgtgtggatgtctagtgggtatttcaaacatcctaagttcaacactgagctcttgttcttttcctctgagccagctccttccatcatgagttcccatttcgggaaatgacaactacatctttctggtttttctggccagaaattttggtatcatcattgattcttctttttctcttatgcttcacccttaggccccaggtctgatcaaccattgccacctttactgcaaccagtttaccaaatgaccgtcctttctcatctggattaacaagatggcctcctgagtggtctcccggcttcagcacttgtagcccagttgcatcagggttgagtgcggagtgaggtagtgaagtcagaacttatcaaacttttgctaaaatttccccattggcttccattgtcccttataagtccagggtcccataagacttcttcctcttactttttaccctcatctgtcatcccccgcactcactgcacttcatccaccctggtgtcactgctggtcttagaacacagtggactgactcccacatcagcgactttgtacttgcttttcctgctgtcaggaaacctgagtgcatgactctcttcatcagctgcttccctttcttactcagataccccgttctcaacgaggcctttttaaaacaatcttccttgttgaaaattgccacttcttccccagatttcttttttcctcttcttccttttattttttctatagcattatcattacattatataaaggtgtttctgttattattctgtatgtgtcttcctgaaaaaaaaaatctgtgaaatcataaaccaaaataacacaacttatgaaaaaagttatgtacaacactgaaaaaagtgttatgtacaaaccttcaaaaatctatggaattttgcaatcaggacactaataaagaaataatactactagtaactttcttcattgatttgctgttttgataaaaagagaaagggcttccaagatgcaccttcaacttctctcaatagtgtaatgtcatagaaagtgaagtggtttgtgaagcccctaaactggccactagtcactacctgcactacacaaaggaaggccctttttttttttagtttttaaaattgtaatttgttgtgctgctgctgctgatcatttccttttattttaaggctcacctttgggttcagtgataaagcttgttcataagcaccttagatccttaatattccagggggaaatcatacataaatcactacaacttctgtgttatacaaatatcagttcctatctctcaaccacatatgaagtaatttgaataaaagaaatatgtgcgttagtaaaaccgactatactatatattttctttgtttcctgtttatctccctaaactagaagataagctccatgaaggtgtgatcctattctgtgttcctttttcaaaattctcatttgtgttcccatttcatagacgtttactaggtatttaagaaatatttgttgaatgacagagcaaataatcaaaccaatatctagacttctctagaattctgaagtaattgaaagtatgaatgctttcttttctttaaattgaacaacttctttggcttaatagttagtgacatttaagacggtggcctgatttatgtgtgttatttagaaagccaaaagtaaatgtgttgtggatgaagttcaagatccagcattctgtaggaagatgcaatttcattctgtgacaacatgttttaataggaactaacacgtagattgtgcttttctagcaggtgctggcgtaagcattctgcacacattgggtaatttaatccttgagacaagtctagagcagcagttcccaaagtgtggttcaagaacctgtggcagaccctgagcccctttgcagggggcggccacaaggccaaaatcatttcatcagaatagacctttgtactttgtccccttgttgagcttttggcaacgatttaaaagcagtcgtgagaaaacttctggcacctgagcgcgtatcccgaggcagtggtgccaaactacaccagctggtgtgttactcatccgtgccacacacctatgagtaaaaaccaaaatctagctctctcaaaaatagccttaaagtagtaaaaattattaattctattaagctttgactcaaataaaattattaaaatattctgtgtcgaaatgtgaattacatataaactcttctgctgtacgccaaaatgtgccggttgtctcaaggcaaaggatttgggaggttgtccgagctgggagttgaactggctgcttttttgcatggcaccccatttttacttgaagtagtgactgacagaaaaactatggtaatttagacttgggtattttgcaggattttcttgaaaatgaagaaaataagcttgttgcatcaatgaaaacaactgacagtatttgtggctaaagataaaaattgagctcataagtaaaaattagcattttggaaaccttgaatatgcccaccatgagcttgacactttcgcattatttaaggaggtgtctgatgagataggtagctgtgttaatttgtgatattttttacattgtataatgaaacgtgtcaacgtttggaaggtctgcatcactcagcgaaccaggaaagacatgtgtatggataagatccattccaagtacaggacagtctgaaagatgttaatgtaacaaagcaccaaagtgtcatttatgcggtttcagagtccgcgttgcaactaacctttatgaaactgacacttgtttagttttactaaagtattaacaaaaatattcacagctgtttgaaaaggcaattaaaatactcccctcctttccagccatgtatctgggaggctgtatgttattaatatccttcaactgaaacaacatattacaagagactaaatgcagaagcaggtgtgagaatctagttgtcctttattaagctagacactggaaaaatttgaaaaagggttaaacagtgccactcttaagaatttttagttttcttttggataatatagttatttttcataaatgtcttttgtattaataatgtaatgactttgattttttaaggaattaataactttttaaagttcacaggtttactctctaatatgataaatacagaaagaaataagtcacataaacaagaatttaggtgtccttaatttttttgtatgttgcaaagggatcctgagaccaaaaactttgagaactgctgctcttgaagaagttggtgctattgctttgttgattgagaaacccagacataggggttaagtagattgtccaagatcacagagctagtcaggggagagctgggatttttctttttctttttctttttttgagacagagtctcactctgttgcccaggctggagcgcagtggtgtgatctctgctcactgcaatctctgcttcccggtttcaaacgattctcctgcctcagcctcccaagtagctgggattacaggcacgtgccaccatacccggctaattttttgtattttcagtagagatggggtttcactgtgtttgccaggatggtctcgatttcctgatcttatgatctgtccacctcagcctcccaaagtgctgggattataggcgtaagctacggtgcccagcctccccaccccccgccacccaagacagagtctcactcccttacccaggctagagtgcagtggcacgatcttggctcactgcaacctttgcctcctgggttcaagcgattctcctgcctcagactcacaggtagctgggaccacacgcacacaccatcatgcccagctaatttttgtgtttttagtagagatggggtcttgccgtgttggccagactggtctcaaactcctgacctcaggtgatccgcccacctcagcctcccaaagtgctgggatcataggcaggagccatcatacctggcatagagctgggatttgaacccagggctccaaagtacttgctctaaactcaaatcacatattattacttcttgagaaacctccatggtttgtaactttgctaaaatcaataagctttggttggacttagatgtcctttcaagttattttctcatgtaatttcttgatataaaattaaaccttcaccatgtggatatctgttacatctcagtttttatggcagtacatatttgccgtaaactcaccagcaaacagataagcaggagaaggtaaatcatatttgagattcttttcttggacctttcagttttttatttaatcagggttgatttcttaagattattcgaaagaatctttgaaagaaatattgtgccatattcaagaataatgttggttatttctgataaccttactcttattttggttggtcatactttttcactacaaaccatagaaatgacagttcagtatacttctactttgaagtaaaatattggagagctggaagcttatttcagtttggagaaacgggaattgtatttatcccactgtgtcttattaatttatatactgaaatagattagcacagtgcaagataaaactagtacataaatatagccatatatgtttctaccatcagcttcaattgtggattaatctcactggaagcttgaatggtttcttaggggaaaatattggaagggtaggtttacccccagagttcccttaaatatggtgttaatttgcattgatttcagagaaaacagagaatcagtttgacttccccactggctgactgcataggcaaactattcacagtgctgtttaatggaaatctcagggaccctcctgctttctctgttttcacatggactgactcaaatatggagaggacaccagggacaaattacttggagaaaatcccacacttgttagtcagatttttgagtacaaaatgatgactttgtggtgagatcaaggaatacgcagcacaatctttgacttgtgttagtttttttgtttgaaataagagatatattctttcaattgtagctgcctttcatcctgaaatgtctgacatttattttacaaggcagtagtagagagagataaggtaaaatacagagaagttgggtgggtaatttatttatttattttttagattgacagaagatgatggtacatctaagtatatttgaaagtctaccactgggaagtatttagaaatatttatgataagctaaagaaacaaagcctgggaatttgctgtgataatagagccaactcttttcactggagggagaattacatagtttgggaattagtatgtaccattcgtttatgtcctttttctcctttctcctcctgctcttcctcctcttgcaccgccgcctctagttcacatttaataaccaaacgacttacttgggtggtgacaaaaagggcagcctgaactgccctgtcctcactgccttttctcagcttagcagatagaggactttgtcctaaaacaatcataggtctctttttcgtgtaatgccttcttttcctctgggtagatacccaggagtgggattgctagatgaaagggtagttctactttcagttctttagggaatcttcacactgttttccatagtggtcgtgctagtttacattcctagcagcagtgtaaaagtgttcccttttcaccacgtccctgccaacatctattattttttgatttttgaaaaattatggctattgatcaggaaaatgcaaatcgaaaccacaatgctatgcctccttactccggcaaaaatggccataatgaaaaaatcaaaaaataatagatgattgtggtgatggggtgaaaagggaacacttttacactggtggtgagaatgtaaattagtacgaccatggaatactattcagctctgaaaaggagtgaaataatggcattcacagctacctggctggaactggagaccattattctaagtgaagtaactggggaatggaaaaccaaacattgtatcttctcactcctaagtgggagctaagctgtgaggatgcctaagaatgatacaatggactttggggacttgtgggaaagggtgggacgggggtgagggatacgactacacattgggtacagtgtacactgctcaggtgatgagtgtaccaaaatctcacaaatcaccactaaagaacttactcgtgtaaccaaacaccacctattccccaaacacctatggaaataaaaaaattaaaaatcctatcataggatcctcttacagcatcataatgtggacctgtctatatttgcatatttaactagagtggcacatatctagttatctatttaaacctcaccccagaagtacatttgaaaatcataattgttgtccttaaaaagattgatattactattatgaagaaagcacattgcactgtgagattaaattcctggcttcaataggtatacataatgaactgccagcagctgaaatttgaatgactacacttaccagaaaaggatcttctacccacatttctcagaatagttgttcacaaatgatacattctgccctgtgcttttgtttctccctggaatttgaaaaataaaacttttcgctcatggtaaattcataagcttggggcatgaaaatgtttgaatttgatataaaagaagttttgaaaggaagattagtggtttaaactgaaagattagtcgccctgggaaattcagctgtggcaaaagcggagttcagtaataacctgccctggctgattactccattcacactggcattctggtcctcccggctggactcgcacctgattgacggtgctgattatgatggcttaatacagctcatcgtcacttcaccgggacacgtggactttgtgggcttcacagactaccccccaccccccttgtttgtggtacagttgattcttctgctaagtggaggttgattatttctttattcattatctctttaaaatgcaggagaaaagggcaaattatcaaataggtgatgattatcctagtggaagctctcttgggcagagtcaaaagaagaacttgcagttcaacttgcttgatacctcatagttgattcctattcattctgccgttgaagggtttcagatgatacgacttaattttagctgttgtggaacagcaatgaaaatccatcgcaagaccccctttcttgatgttagggaagccgggggacgcaggatgaggtagtaggctccagctgctgcccatgtgaatgatttttcctctgcagatagatgggtcatggtccctttctagatgagcagaagattattctcacattggagaggtaacattaaatacatttacattggatctgaaaaccttaaatgtttacttagggaagtgtcatcttcacataaaattatgatgttgtgtaagccttcctttttctccacaacctctccagcacctcttattttttggcttttgagttacaggcattctaactggtagcttattttggttttgatttgcatttctctaatggtgggagtgtaaattagttcagccattgtggaagacagtgtggtgattcctcaaagacctaaagacagaaataccgtttgacccagcaattacatcactgggtatacacccagaggaatataaatcgttctattatagagacacaaagacacatatgttcccaatagcaatgacatggaatcaacccaaatacccatcaatgatagactggataaagaaaatgtggtacatatacaccatggaatactacgcagccataaaaactatgcagatcatgtcctttgcagggagatggatggagctggaggccatcattagcaaactaacacaggaacagaaaaccaaataccacatgttctcctcctataagtgggaggtaaatgatgagaacacatggacacagagaggggaacaacacacattgagtcctgttggagcgtggaggatgagagcggggagaggatcaggaagagtaacaatggatactaggcttaatacctgggtgatgaaataatctgtacaacaaacccccatagcacaagtttacctatgtaacaaacctgcacatcctgctgaacctgaacttaaaagttaaaaattatgatgttgtcttgagacaatgttaagtctattcctgtcctttgggcagaccttaaacctatattatccacacagatgagactctctctttcataaatgatttatgttctattttaagaatagaacactttctatatgaaaatggaaatttcacttttccttagtaatttattctagggtcttctaatgttcgttgttagaatacagaagtattcctaacgtctgctcattttcctgaggaagggaatgtctattattatttgaaatacacacacacccttcaaagattaatatgtgggccattggcttttccccaggtcagagttttataactttaccttagaggcaactcaatcattttctttatgaatcatttcaggatgttctctttcccatttaaagtatgtaaagatcaaatgcttttgcagggcatctgtgcagacttgaatactgatccttctttctccctttctgtccccaaagttttgtgttttgttaccttaatgccctcttttaacttgtttacctactgtatgtatttcaatggtaaatagtgctgggctcagagaagtgctattccccaccttggctaatctatgtcaaaatacgtgtcgttatgattttaatttgaacgcttaaaattccagggtgttgacatattttcccttcccttctccttataatgaatgttagtgtctgtgctaaccataattttacggccatttggatctcgagatatttgcttgccagctatatgaaaccattctttaaaatgagctttttttttcctaccagctcacagtatccagccttataatttgtacatggtataggcatgtttgtttaactataaagtccatgaaaaattgagttgtagtatcattttaattcaaatccgttgtatactatattaaaatgatgatgctctatcaatagcaaaaccaaattcagatttttgagtttctatctcgaagcttttccctttcgaaaagatgtatgttttctatgactcattcgtgtaggacactggaaccatatgaagtggcatttctttttctgttgttaaacagagtgcaaatggccagacattaataaagcctgtagctcagtaaatcccacaggatcaaagctacctccattgcagttcagctttattagactgtttgggtaataagaggagatgatttttgctgaagtacataggaaaaaggaaattggacacatggctacattcaaatttaagaatgcagttgatatacagcttaacgcatgtcagttgcagcagaagcaggcagaactcttggaacaggacaaggctcgacaactcctgactttgagttacatgtgctgtcacagcatctaacactttactgcttacattcctgcatcagacctagattataagcgcttaagggacagcgactgtgtcttacactttgtattctcaatgctgattacagaggctggtacatagcatcagtgcatgtttattgaacagaaagttgtacaagtcagagacataagaatccttcttgacatctccctctccctcacatccataaccaatctatcactgaatctttttcccacctaactattgctttaaagcggatcactgcagtggcctctggactggtgtcctcccactattccacgccctctttttttccttctcacattacagccagaatgttcttttaacaacacaatcacacaacctcttcaaaggctttttgctgtctttttttttttttctgagacagggtcttggtctgtcacccacactgccaggctggagtgcagtggcacaatcacggctcactgcagccttgacttccttgggtcaagtaatccctccacctcagcttccttagtagctgggactgcaggtgtatatcaccacactggctaattttttaaaaaactttttgtggagatggggtctcactgtgttgtccaagctggtcttgcactcgagctcaagcaatccttccgcctcagcctcccaaagtgttgggattataggcataagccaccacaactggctgtccttttgtagtaagagctaatcatcatcatcatcatcattatcatattgacagtactttttacaaggttataaatagggtgatcacacacgttgttaatactcggacacttgaatgtgaggtgggcagcatggacagtcacgcaacgatgaggtgggaaccagaacacgtgtggccctgcctgcaaggccctgcacaacctggccctgctcatcccacttccagtcactctctttgcacctgcagaaagtcttgctgttcactctttcgtactgcccaagggtactcgccatgtttgctcccaccagagggcctgcttaacggtttggagtgctgccaacacttttgttctcagctcctgcatttcatctcatcgactaggttaaatctcctactgtaagttcttgccgtactcatagatgcaatttaatatttatttatttgaatgaataaatgaataaatacttgtgagaggttggtaatattgtattactaatataccaattatgatggaatatagtgatcaacaaaatgacaaaataacctatgtatttatatttaaattctatatattcagtttatacactatagtttaatgtgcaactagtttcagtgttaacatttctaatgtgctacttgatgtttattaaatgtacagtagtttataagaacagcttagtaatgtcacaaataaattaccaaaaatttaaagttgagtatgacttcttgaaaagaaattttccgtattaaggaaatatgtgacatttggagtcaaaatatatagaattggtagattctggagctagattatctggatttaaatcatgacttcactgcctactgactgggtagcattgagcaagttatttaacttctccatgcttctgtttattcattcttaaaatgggtataatgatgacatctatgttatagggcttttgtgagaaataggttaatatatatataaggcatttagaatggtttccagcacaaagtaaataataaatactagctattgctgatattagtgttattatatttattcattcaacagatatttattagctatccccttagttcctggcattgttctaggtgctaggaattcagaagtgatcaagactaatgtactgtagagtaacctacaaacactttaatttcagtatctgataactattgtaaatggaataaacataatgacttgttagagcatattgtgcaggaggagctttagttaacctgaaggatgagcaaagatgagcatgcacagagcatcctaggtagaggaaagaccaagtgggaaggccccacagtaggtgtctcactccgttttctgctgctgtaacagactgggtgattcaaaaatgatggaagtatatttgactcttggttctagaggctggacagttcaacaacatggcagttcatctggggaggccctttgtgctatatcatcctgtcatggaagtcagaaggtcaagggagtgcatgagacagaggatgggggcccaacttaccctttttattaggacccctctcccttgataactaactccctcccacagtatcagcattaatccattcctgaaggtagagcctgcatgacctaatcatatcctcaaggtcctgcctcttattactgttagaatggccatcacatttcatcatgagttttggaggggacattcagaccgtaactctaggaaagagcttggcttgggtttaaatgtgcaagaagtgaagtgtgcctggagtgctcggtgtgagcagagaggggaggaggcctgaatgaaagttagaaagctgattatgcaggtggatcttggggacttttgtagaaaaatgacgagtcatataatcctgtttattttgctgataaagaaacaaaaacctgtaagtcctgatgaggatcaggtagctaattagtgatgctacagctagaagccaagtgtgctgcatccatattaaaaaatgttattgaaacagatctacaaaacattgacaaatcatatctagtattctctccattttcacaaagtaaatgtacctttgtaaccacatcaggaaataaattttgacctgcttttcataagccatcccattaccttcacccccgtcgctatcccatccctcagaggtaacccttatccttaacctctgacaccatagattagttttatctggctgtgaacttttatgaacttttgaatagtagcacatgctataagcttttttgaaaattctgtctggcttctttcactcggcttgatgtgtgtgggatttacctgtgttgctatgtgtagcaattgttgctgcattctcgctgcagtgcgctgttccattatgtgaatataccatgagtttcctgtgttgtatcccattgaaagtcaccaggagagaccatttccacgtgtgtatgaaaggaaagctaggttgcgattcatgtcgtttatgtatgtatgtcaatcttgcttatcttacttttttaaaaccaattgaaggttatagaggaaacttctcttttatagcctgcatacacttgactgttttctcgcaaatagattgcctagttaaaaccaaaagcttgtatgtacagggattgtccgatatgtcccttcaataagctattaaccataagtggaaataacttggatgaacctgtcagatgctttcaaatgcgggtatcattgagctttcagctttttgaaatattatctggggtattgcatgtttccagggtttggtaaaggattatttacttcttaattgggccaaacagccatcactttcattttaatattacgtttgtttaaataatagatttattaaattagatgagtgccactttcatgcgtacttcagttttgttttgttttgttttttaatatttcagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtaattgatcgcttgaaaaaataagatcccatttcagttgatgtgtttggaatacttgccttactggtcataatagcacaatgagtgaaaatattggattgaatttctaatgcattcaagattaaaggaatagatttgaatatgtaattagaatgtgatttactattctgatataggttgtacttacacctaggaagtctatcattatatttgtaaaagtaagcccattagtgaaattatcagtcaacaaaaacctatggttacagagcaatgccaataacagctttggtatgatacatttactttccaagggcaacagccctacccacaagtattgctcctgtctaggcacaaatgtttaaacagatctttagtatggtagcttctggagctctgagtagtcagcaaaagtctttcctagctgttttcaagtggagatagggatggatggaatcatggagaatgggcatgcatacagcctgtatattcagcagcaataaaacagtatatattgaagtcctgccatgtgcccagcactgtgccagtcaccagggatctgatgcactggggtggacatgatgtggggacagagggcctgaacctgtggcagagcacaagatcagggtaagactgaggtgtagattcacctggaggcagtagcacagcctttggagcctcagggtcttaccacgcttcagagctttccaggggtatacttttgaggatgataatattacatgctgcagttctgtgcaggatggagaactagcatgccagaaaagtccaggaggcctcaccatcagcaaatcagcaaaatcatcgctgccatgcttttctttagatgaaataagaaagagtgggctgtatagaggcattttaagtggaataacaagcttctcaaatggggaatagcccacccactcactctctttacctctgaggttgtgatacggtggtccgtggaaccacactcagcctgcccagaatttatgtgtgtgtcagttgtctgtgtgtttgtattttaaaaatcaattaaaaaaaatatgagaatgcttacagcattttttttttttttaatttgagacggagtttcactcttgttgcccaggctggagtgcagtggcgcgatcttggctcactgcaacctccaccttctgggttcaaatgattctcctgcctcagcctcccaagtagctggttctacaggcgtgagccaccacacctggctaatttttgtatttttagtagagatggggtttcaccatgttgaccaggcttgtctcaaactcctgacctcaggtgatctgcctgccttggcctgccagattgctgggattacaggtgtgagccacagcatatttttttattagctgccaacatttgacagttctaagattttctgtaaaaaccttgcttcccagcctctgcagaccagtcagaaggcctggctgcctggtctgcagccccaatcaggagcaggcggctgagcagagctgcccccatcaaaggcatggacactccctggttctcctcggtgctctctggcagccccgtcccttgtagcacctcacttgctctccccattcccattacccacccacactttagacaagtgagtgtgtgactgcttacattattgggcctaccctgttggaggatctacactcgaggaaaagtttatcatagtagatcatagcatgttgaaatcaaacagtcctgaatcctaggactggcagaattcagctccaccacacctgagcaatggtgttataactttaggcaggtgacccatgagccctcccctcccgtaagtgaaaagagagtgacgtaagcgtttgcaaaatgggaaagatccctcctcatttgcagtgttgtgagcattgaaggctctagtgatcgtaggcagcattatacattattaccatgtgacattgtaaggctcagtttgttagaaggggtgtaagaaagcagaaacagaaaaagtgaacttagagttgagaaccatgtttgagtagtgactgataacagaagactggagttcagggacttgctcttcaacttaccggtgtgactttggacaagttatctaatgttgatctttttccattggaaaaatgagtacagtaaggcccacatcaccctcatttttatgagagttctcttaaaaattaaattacatagtgctttgtatgccccagaaagaaaggaatggagtttcaaagaacccagattgttcttcctaataagaagtaggcatgatgtggacagtgtgtgacagtggcctggtggccaggctacacgccttggatggcgggaaaggaattgtttcctagatcttcagtttccacatggatgttttctgaaactgaattccccaagaacaggcctttgtgtaggcaccaagccatttctcttttccgaccacctgtaatagtggtttctcctccatcccaggagaaagcgcacctgtaccttatctgagtcttcctgtggaactctctctggggggtgcaagagtaagacagagtaatatcaaagttcccactattaaagaattcttttgatttttaaatggataatatgggtctcaaactattatttgcaaatcgttgaatatacagagggtccccaacttacgatggttcaacttaacaattttttgactttacgcagttgagaaacccttctgttttttactttatagtatttaataagtcacatgagatattcaacagtttattataaagcaggctttgtgttggatgattttgcccatttgtaggctgatattagtgttcggagcatgcttaatataggctaggctaaaccgtggtgtctatgagggtaggtatgttaaatgcatttttgacctagggtattttcaacatacgctaagtttattgggacataacaccttcataaggctagcagcatttcaatttaaaacaattttgtaggcccggcgcagtggctcacacctgtaatctcagcactttgggagggtgaggcaggcggatcatttgaggtcaggagttcgacaccaccagcctggcaaacatggtgaaaccccatctctactaaaaatacaaaaattagccaggcatggtggcgcatgcctgtaatcccagctacttgggaggctgaggcaggagaatcgcttgagcccaggaggcagaggttgcagtgagccaggatcgcaccactgcactccagcctgggctacagagtgagactccatctccaaaaacaaaattttaaaaaaatggtgtaacggctttattttaaatgccaaagtgtacaaaaaactgttatatatgcaacctttcagaattataagacaacttgcagtcaacttaaaactgcaggaagaggtggaacactctttgtattcttaagagcccttgcatatgtatttgttcattggaaacacaagaagacaaaacgttgttggttgtattgaagcaagattgagggagtgactcgttatatgtggactattaaaataagctatgtgcttcactactatgacatgggaaacgtaaggaggaatgggtgattctgaagcaagaattgtttggggtatttgtgataaattatattatgttccacgagggcctcagacacttagatgggttatcaggaatctatcatagcttgcttttttttttccccatgatataaaacctgtctaaaaatctcatactattttttcaaattactctttcatctacttccttccagtaagcatgttcatttatcatatgttagccttcatgagacctttgtaagtttcaaatgaaaaaaacatggatactttatgaaaaaggtagttgtttcccaccttaacaggacccttatttttccccactttggtgtcagttatgaaaatgctaaccctgtaaagagcaaatactacacatttactttttctagctttgacttaaaataacattttctttgctgtgtgcgttacacactgcacagtgaatttcaagtgttgtatttcttttttttttttttttttttgatgtggaatctcactctgttgcccaggctgatgtgcagtggagcgatctcggctcactgcaaccttcgtctcctggtctcaagcgattgtcagcctcctgcgtagctgggactacaggcatgtgtcaccacgcctggctaatttttttattattagtagagaaggggtttcaccatgatggccaggctggtctcacactcctgacctcaagtgatctgcctgtctcagcctcccaaagtgctgggattacaggtgtgagccgctgcacccggcctcaaatgttacatttcatattgatgctcatgtctacattttggtggcacaggtgactacattagcaagttgacggtaattcagcaattaaactaagtttgcatagatatcttaggtggatttgtattctttccagaaagcatttagtctaaattattttctactttggaatgaaaaaatcttttctaattatattcaacatatacatacacctaagccgagaatttcttaatgctaggcacaatatttattattgtaacagaaggaataattgtatactctaaactcctaaaaattttatagttttcttatgtaacctgcctctgtggttcaatttctatgacaatataaaaatagaaatttgatggatgtttattcttgctttattccagggaaaataagaatggttaagggaaaggttatttttttcttttgttttataaaaaggcaaacatttcacagtatcaataaaaattatgaaatacctgggaataagttttataagaaatgagtagaacccacgtggaaagtgcgtaatgagatataaaagatgatacttatgtaggaaacccacttgctataaaaattacagttcctttgaagccatcatagaattttagcctaacatcagtagaacttttcagaaagctaatatcaatagctgattttattttgctgagatagggtctcactctgttgcccaggctggagtgcaagtggcctgatcatggcttacttcagattcagcctcctgggctcaagcagtcctcctgcctcagcctctcaagtagctgggaccatgggacccaccagcacacctggctaagttttctattttttgtgcagatggggttgcactgtgttgcctaggctggtctcaaactcctggcctcaagtgatctgccagccttgacctcccaaagtactgggattacaggtgtaagccaccacacctggcctggatattttaataaaaaatgccaatgggattttctggggaagtaactgatgaagtttttctaaagctcatctagaaatgtaaacagaagaataccaacaaattttcacaacattaagtgaataatggggaggaacttttttttctaaaacccaaggcatattagaatgccataataagtaacatgttaatagtataaaattaaacaatatgccagaggagcattttgaaccagaccattatatttataaaaaatatatgatcaaggccaggcatggtggctcacacctgtaatcccagcactttgggaggccgagggaggcgcatcacctgaggtcaggagtttgagaccagcctgaccaacatggagaaaccccatctctactaaaaatacaaaattagctggttgtcgtggtgcatgcctgtaatcccagctactcgggaggcaggagaatcccttgaacccgggaggcggaggttgcagtaagccaagatcatgccattgcactccagcctgggcaacaagagcaaaactctgtctcaaaaataaaaattaaattatatatatattcaaatgagttctcaaaccaatgctaaaaacaactttttgcaaacattcaaaatagatcctcattaaacatcaaaataaattttagatacaatgaacaattaaatataaaaaaatggaaacataaacaaagggaatatttgaatgatctcagattataccaggagaaagtacaaaagcattgagaaacttcatcagaaaccgatcacagataaatttacaaatatttacaagttttgtataaaagatacaaaatttttaattgcccatttgcttaatcttataagttaaaaggtaagcaacaaactgggacaatatttgcaacaaatcagacagttctgtctctaataacttgggatctcctgatgacagtggtggagacaaagcttggctctccttctttgtttgtgaatgtcatcccaggaagcaggtgtaaaggcaggggaatgaagcagggaggaaggaagcaccagtgcagggatcccttatcaagttggcagtcactctaagtggctggagctcaatcttgtttgcaacgtctatggagtcttatgaaatgcatctcagaagtgcccactctaatgggtgaaagaggaaattatttatcagctcctgtacttggctgataaatatgggtcccatggttattagccttcatttctaattagctcaagcattggtaagcagctaaacctgctggctgtggtgccagagaatccccaggacaggaagcaagaaataggaggcatgggttgaggcaaagtgatgccagctgcgccaccataaagctactcagggctgcctggaagtgttgaccacagcagcagctcaagtaaaaggtagagccagaaggatttttctttctttcttttctttctttttttttttttttttgagggagagggtctcactctgtcacccaggctggactgtagtagtgtaatcatagctcattgcagcctggaactcctagactgaagtgatccttctgcaccagcctccctagtagctgggatcacaaatgggtgccaccacaactagctatttttttttttttagacacagggtcttgctatgttgcccagcctagtcttgaactcctggtctcaagcagtcctcctgccttggtctcccaaagtgctgaggttacaggtgtgagccaccacttccagaccgaaaggatttttaaaatagagagtaagaggacaaaattgagtctattccttgaacccctcagtgtaacttgtacctgctgttaagtctaattcatgaaagagtcccttctaagaagatagtcagctatagtttctaacaaggactttattcaagagagttagtagaacaagctatttttcttactggaccaagtctcaaggctataattggtatttatgttctcctgcccattttaggtatgcataactctcagcctgctcttcagctagtcgaatttgcttggtgctgggtggcccaggccctcatctcaccttttagttgccttgcctttgtagggccatggattctctaattacaactggtcttgcgagtactaagagataccccattgacttctctcctcctcacctctgctgtgtggcaccagccctagtgtcttagagtgattagagtcatttacctccatcagtgtagtaacgcctttctttttcaccagcccactggcatgaagttcacaaagtgagtaggatgaattagagtcaaattctctgggtccctttttcttctataggaaatctcccccactgagaactcagatctgtaatccaaaagagcctaaagttgggaaaaaaacaaatagatggccagaataggggccaatcatatcttgacctcaggttcaacaatttttttttttttattttgagacggggtcttgctttgttgcccacgctggagtacagtggcacagtcatagttcattgcagcctcgacctcccgggctcagttcatactcccacctcagcttcccacgtagctaggggtacaggcacacaccaccatgcccagctaattcttttatttttctgtagacacagggtttcactatgttgccgaggctcgtctcaaactcctgggctcaaatgattcacccagcttgtcctccccaagtgctgagattacaggcgtgagctgccatgtccagccaacactaccaggcattgttccgaatcctattatcctattagtgtggctacttccaggtgatgtaatagctactaggactaccggatcctctggggaaagtgcctgttttcatacctccttcaataagtacaatgagtccctgatctgggacaattctgtgcaggctgccacgtgtataggaggtattcatgcttccagattgcggtgctggcctagtcaatgagcagagaaggcagatccatatccagaggagatcctgagtttgattaggaagagtcactgcatgtttccgtggtagaaaggtcaaatataagcatccagtcccaagtggccagcttgaagaattgtgtcgcactgagggctcagcatcagtctctgccgttgccacgtttggcatctggcattggcaaaagctagattagctttggtgaggaggagctgttgcttttggattcattcatagcctcagtccttgccaacatgaccgattgatgtcccattttattagttgagaagaaatctaaatgacacccacagttgagtcatcctcttcaactgatcgatgagtgccttatctgaagtggatgctctctagtgatataaaaaatccacatattacacccacccccattgggctatttacatatgactttcttgtttctgaatttccagtcctgtttctcccaggcctctttcccatcagccaagccatttgttactgcccaagtgtctctttatatccattctcaagccatttctttctcaaatctctccctattcaaagttaaggaccaaaggtactacttgcagctccgtctgcttggaaggctcttccttaactgcgctccctttggccacgcatgagtaaggccatagtgtgacatcttcattttccggatcaagttgactcatgtataatcccaggcctgagtgtttaactgttctatcaattggtgaggcctgtgtataactgagacagtagtcttactcttgtggctacatagttctgttaataattccctcataatgcttatctccagttgcatattttctttctttcaagatagaatcttgctctgttgcttaggctagagtatatatatatgtatatacaaaatatatatattttgtagagatgggatctcactgtgttcccaggctggcatattttcttaatacctatggggtcaggacttcagtttgtcctaaggacatcagtgtatgtagttcccttctgcagaaggcatgatcttattccaggaccttatggatgcatgtttgactcttctttggggctactagagactccccacaacatccttatccacaacagatatctctggcaacattctatatgctgggatacgtggcttatgtgaaagggcagcttctagaactattgtctaattctatggctgagtcctgtcttcctctttgtctccctaaaaactggcaacctgggtcaagataaagtaactgggatctgatttactgcctcatttgaaacaactgtaaaactggacaaaaatatgaacagttgttttcaagacattggatatcaggcagtgaaagattgtgatcgctgagagatggaagacaaacaaggtgagccctatgtttgccctctgcttactgccttgaggggatttctaggctgtggcacagagaaggaaaacccaggcagaacctagaggaccttctgagttgaagagagctgagagtttggaaagatcaaggcagctagatttcttagggcagggtactggataagagagcactacaggccaagcgcagtggctcacacctataatcccagcactttgggaggcggagacgggcagatcacgaggtcaggtgattgagaccatcctggctaacatggtgaaaccccgtctctactaaaaatgcaaaaaaaaaaaaaaattagccgggcatggtggcgggcgcctgtagtcccatctactcgggaggctgaggcaggagaatggtgtgaacccaggaggcagagcttgcagtgagctgagatctcgccactgcactccagcctgggagacagtacaattctcagtctcaaaaaaaaaaagaaaaaaaagaaaaaaaagaaaaaagcactacacagagaaagaatgctggaatcctccagagggtccccctttaatatttggcagaatattcgtcagcacattcatgtgagaaaactaccccaggcaagggaaaggactatccaagaagattagaggcaatagttccctgtgcttacacaggactcggcggagtgtctgttctcaccagccaaatcgtaaaacctcatattcatgagtttatcagatagcctgcacagaggtgtcttgggtcaggagaatgattagccctagaccaaatactgctctggttctgcctaacaagtcttgaaaagcaagatccaaaaggatcaaactgttgctcaatatcttcacagtatcagagaacaaagttaatgaatatttataggaatgcaaaaatttccagtacccaacaagggaaaattcacagtgtctagaatctaatcaaagatcatcaagcatatgcagatgcaggaaagcatgacccataatcaggagagaaatcagttgattgaaaccaagccagaactgacacagttattagagttaacagagaaagataatgaaacagttataactgtattgcatatgatcaaagtagagacacgaaaaacacaaaaaaggcagaaatctaacttataaggatgaaaactataatgtgtgagataaacattggatgggaccatcaggaaactagacatcacagaagaagatattaataaagctatagtgatagaactatccaaaataaaaggcagatagaaaaaaaatcaaacataatgaaaagggcacaaatgagttgtgggaaagcttcagatggcctaatagatgtgtagttggaatcccccaaggaggcagtcagaggaaaaatatttgaagaaataattttttcaaatttgcaaatcccaattactggagttaccagccagtgcaataaggcaagaaaaagaaataaaaggcatccagattgtaaagaaagaagtaaaactgtattttcaagttacatgatcatttatgtagaaaatatatacttttaaaaagctgctgataagtgagtttagcaacattacaagatagaagatcaacatataagaattaattatatttctgtgtactagcaaacaaatctgaaaattacatatttaaaaatttaaggtaggatgggcatggtggtgcatgcctataatcccagttagttgggaggttgaggcaggagaatcccttgaacccaggaggcagagattgcagtgagccgagattgtgccattgccctccagcttgggtgacagagcaagactccatctcaagaagaaaaaaatttaagatagtacaaaaaaatctgaagtaaggataaatctgacacagggtctgtaaggtctttacactgaaaactacaaaacaatgctgaaagagagaagaaaaagaagacctaaatcaatgggcagatacactgtgtttatatatctgaaggcttagtattattaacagatccattttttccaaacttatcccttggtgatattctttaggcccgagaccctgagacaaattacataactaaaatctaaaattcatcactaagctgtggggaagatttctctacaagatttttttttgtttttggagacagggtgtcactttgttgcccaggttggagtgcagtggtgcaatggttcactccagcttctgccaccccagctcaagtgatccccccatctcagcctcccaagtagcttgggactacaggcacatgctgccacgcctggttaatttttgtatttttaatacagacagggtttcaccatgttgcccaggctggtctcgaacttctgggctcaagcgatccacccaccttggcctcccaaagtgctgggattacagatgtgagccaccacactcagcttctaatgctttctgttttattttcttttaatctattgagctctctctgtactcaccaagaagaaagtctattatatttaattgagaactcttttctcagttggtttcctcatcacccaacctaattgtgtgtaactcccatctacatcttcgtgaaaagggcttaatttctctagttgtccatcttgatgttcagctttcattttcctaaacttggtttatgtcagctctctttttctagttaactcctctttgctcctgtcctctatgaattgcctagctttcaacagcaaggacagcaggtgctatcttatttaatttagatccataatattaatgcggtgtgacctcatgttcatattctccccacaaagttgagtgtttttgtatttctggcttcagtttgactgctttttggaactctgtatggtcataacagatatgaatgtttatggagaatctctgaggcagaattagcattaggctttttaaggttctcattggtaaatgatttggatttagataattattggttctttgtttagggatcattgtggaagctaagtgaagaccttgccagaattgaccaaactactctgtaacataattcattgttgacaaatactcccgagtgagacaagtgggagcttttaaaatttatatttttaatttgcttatgcttataatgtttaatagagtggtttaggtcttttttccattatgcgttggaatggatttttttgattatgtagaaactaacatttgccttcatactttaatccttgatataatggtccccaacttttatgttcatagagaacctggcattataaagaattaagtcaacagacatgcaataaaagatttttatccctaagaaaaggcaatgtcctctttcctgaaggttttctgaaattccttttttaccgacttgagagagcaattaatgctcacagtagatttgacagacggttctagtcatctgtgcttcactaaatatggattgcacattttctgcccctgatttaataaggaaaagtaggaatgaatgacgaatgcataatccccaaagcattgtttattttagagaaaatcacataaacgggaatcccagaggaggagtcttgggaacatttcaacattaattcttaggtctttggattggctttcataactattaatgaagataaagtttaaatgtagtcattcatggtatggcatcaataaaaagttatcgaagattaacatctaattgataccaggagagcttatattcattcaccagatttatattcccaaaaccagtgctacagattccatagaccctcccacacagggacctgtttattgcccttctcaagttaatatgaattttgaaataaataatacacagattaaataacttttacaaatattgtgttccctttgtatagcttccatcgttaccatactgtttaatttaacttcatattgattacttcaattgttttgaaagaactaaaaacataacctcagcttgcctgatgcctagggcctattagtgagctgtatacaccatcaaagtcacatatatatctctctcttaacaaatttcagtttgaattgtccttgtgtttttctgagacagcttgttatggcacagtctgggtttttcatttcattattttgctttaggagaaaacctgctatagactcatcccactttggattttttaaatttcatgtagaaaacttacaaaaataaaattgaaaacaattatttatcatgccattccaaaaagagaattgatgtatttccaagaaggacataaatggcttacagttatttttaccttaacccatatttttttttcattttaaggataagaataggctttggtccaaggtatgaaagcttattatagaacttggttgcttattttcatggaaaatagatattttcataccagcataaaaattaaagttgtggagaatagtcttatctaaagtgacataaaatggatattgacagtccccccaccactgaaagagaaaaatcttacatctaattttaacaaatatgcagatttttttcttatgaatcaaattaagttccctgaccacctaggggaagtataaatgttctcctctgcactgacgctgtggttttggcctgtaacaggtagattcggtcatatcatctggcagtgcttggaaaggactgctgaacagtattctaaaatagtattttgttagatgttttctaaaattttagtggctcatactcaagagaacttcttataacaggtaaatgtgtcccagtttaaggggattctttatcttcccatgatttttagtggtttaccaagagccatgtttttttgtttattttttcttttttcataaaaaaagaaatgattctacgatatattatttaggttttgctatgaccgtggtgagcacctagtaactttagaatatatttcagccaaaattattttggctatgttctagggtgtggaattttgaagggttctaaaaccacagaaaccaactttctcttgtgtgagctgttgcatggatggatattggggtgcccttagaatcagcctggagattgggcaggaacagagtgagccacagtcactctggaactggtcctctgagggtcctgctgctggccccaccaaatactggccatcactgcttgagccactgccctagttggcactggacactcccctactcccctggactagggctccactgtgcccccaccaccgctgctgtcagatgagttctcctttagccctcttcctgggcatcaccaaccccagatttaaaaatccagagcaaatgtgtctaattggccatgctgtgtctcagagctggtacctgtagaggcaggtgagtggtctgggaatatccagatgtggtcttttcagcctttaatttgagataagccccatctccacaaaagctcatagggtggcagattctccaaatacagggaagtggttcagatcctaggtagactgaaaatgtcagatgactagtcccagcagttgttcctgggctgagatggacccgatgctgcctcataaagaaattctagggttggtccagtggtccactcagagatgcaggtcacaactgaggctttctcctattagcagaaatggacatttaagcctttggtttttgtttggattttgtgttttattttctttgccattcctgataatgaactggtcctggaaaacactgtgttagttgagtagaattctgccttgatagagtgaatgcaaacattccctgctgtgttgatttgaaataggaacaggcattttctatactttagtggcatatggtgctaagattttatcatactttcttataaagagccaggaaactttgcctgcttaaaaatgtgtgtttataaacaatagacttacaatgaatattcccatctgttaggtgaacataatttgtgtaggaattcccataataggtggaggactttgcaactttcttcatattttttccttggtgagacattagactaaagagatggtacaaaacagcatatgcttaatattcaattttgtctctatttctgcttcttgtttgaaagcagttctatttttgggcgttagtacggaggattactatagaaattcataagaatttaagacctatttaggtattgaaaaacaggaaaaagtagaatgagcaatcatataaatatggttatgttgcagtgataaaactgtctttgtaatgtttcaaatacatactgcaattacttgtgctatttcttcccaaaaacttttgttgactttgttttaagctaatctcacagctcccctctgttgtaatcacagcatgtaataatcaaagccgcacatactcctggtctggatttgtaatttaaataaatggcattggctctttgcattcaatttgacattattgtgattgtattcaataattaattttgttttagatgaaccattccacataaaagaataaaaattttaagattaaaactcaacaatattttttctctttataaaagattttattaatccttccctaggagctcaagaagattatcagaggggaaaacatagtttgattaatttttgtttaatcttgaattacctgtgttgtccaaatgttttagtcgcttaaaattatgcctatcagttcctttttcaggttgcctaattgtgcatacttgaataaaaacatgagcaattagttgaatataagtgattcaagatatgcttgggaactgagcaaatacagcgtagcatacactttgtcttttactcgattttgaaaaagtttctctggttatactttgtaaaaggaaatacttttaaattgtggacaagtattactggaacatctttttgggtgggtaaagtgtaccgtcactctgttttcttctcccctttttggaaaatagtcttttcctatttgagctccttttcttttcttttttcttgagacaggatctggctctgtcacccaggctggagtgcagtggcacgattttggctcactgcaacctccacctcccggggtcaggtgatcttcccacctcagcccctaagtggctgggattacaggctcacaccaccacacttggctaatttttgtattttttgtagagagacggttctgccatattgcccaggctggttccttttctttcttacggtagacaccttcccatatgtgaaaagcatccaatcctcatgtcttactcttttgttttttgttcaaatatgatgtaccttattcaactgcaatgtgcatatattcatttttattttttaatacgatcaacatagaaaaagctgtacatatctaatgtatacagcttgatgagttgggagataattatacgcccatgaaactttcaccactatatgtggcataaatctctccatcacctccagaagtttcctcctgccctcttcattattatttttgtgtgataaaaacacataaaacttaccctcttagtaaactttaaaatatgtgatacagtatgattcctgtaaatgctatgctgcacagaagctctgcaggactcactcatctcatatggctgaaacttcctgcccttggattcctccccgcttcccctcccctgtacccactagtggccaccatttcacactctgcttctatgaactggactattttacattcctcttataagtggtatcaggtaggatttgttcttctgtgtctggtttacttcacttagatgaacctgcatgacgtcatgctatgtagcaaatgccaggatttccttctttttaagactgaataatattccatcgtgtgtatacaccaccttttctttcgccattcctcagcagactcctgggttgtttccatctcttggctaattgtggataatgctgcagtagacgtgggagggcagacatctgagattcttctttcagttcttgggaaatatactcagaagtgggatttgggggtcatgtggtcattgtgtgtgtaattttgtaagaaacaatttttccatagtggctacaccaacttacattcccatgtacagtagttcctttttctccacgttgtcagcaacatgtgtttttcatttttcgatagtagccatcctaacaggagtaagatgacatctcattatggtttgggtttgcatttccctgatgattagggacattgagctctttttcatatacctgttgaccatttctgtggctttggagaaatgtctgtctagtatctttgccttattaaaattaagttgtttttttaagcttttttttcctgatgcagagagagagagagagagagagtgcgtgcgcgcgtgtgtgtgtgtgtgtgtgtgtgtgttttgagagagtgtcttgctctgtcacccaggctggagtgcagtggtgcaatcttagttcactgcaacctccgcctcccgagttcaagtgattctcctgtttcagccccccaggtagctgggattacaggcgtgtgccaccacacctgctaatttttgtatttttagtacagactgggtttcaccatgttggctaagctggtgtcaaactcctggcctcaagtgatctgcctgcctcggcctcccaaattgctgggattacaggcaagagccaccacgtctggcctctcctgtattttggatattagctcttagctatatagtttgctcacaccttactcttaatttgtctgtgaacgtggctgagaactcaattactctaccatcttgggcagcttagaagttgtgggctccggagttgtaagacgcatttcgagtggcggttggttacctatctttacttgctggtggattttaaaacatcctaatttacaaaaccagcagtaaacctaaggcaaggcttttatagaaactgtatcttttaattatttttttcctttgaaattgtactaaaaaatttagacaggcatggatttgaaggatgattacttacagttacagaagtggaaaatccaaaggaaatgactttttaacctctgaaaaagtttttaaagttaacatcagggaatacgtggagaagtaaggaaaggaagtgaatacattgtgctgagagatgtccacattggtgactggagagagacgccctgatggcattgctttctctgccttgacgagttctgtatctcatcctgaaagtgttgtttgcctcttcctgtggagtgacacaagacatcgtgttaagactgttgccagttctaggaatctttggaaattctgatgttctacagagagagaattataaacgatttttgattgagagggctagtttaaatgcagtgacttttaattatataacctttctcattcaaccagttgtgagttatatctcctgtgtgcatggcactgtgctagataccatggttacagtgatgaataagacagaagtagatcctagctttgggtgatatttaaagcccagttggggagacaggtatcagtgcgataatctcagaaataaagaaataccatttgacccagccatcccattactgggtatatacccaaaggattataaatcatgctgctataaagacacgtgcacacgtatgtttattgtggcactattcacaatagcaaagacttggaaccaacccaaatgtcccacagtgatagagtggactaagaaaatgtggcacatatacaccatggaatactatgcagccataaaaaatgatgagttcatgtcctttgtagggacatggatgaagctggaaaccatcattctcagcaaactaacacaaggacaaaaaaccaaacaccgcatgttctcactcataggtgggaattgaacagtgagaaaacatggacacaggaagggaaacatcacacaccggggcctgttgtggggtggggggaggggggagggatagcattaggagatatacctaatgctaaatgacgagttaatgggtgcagcacaccagcatggcacatgtatacatatgtaactaacctgcacgttgtgcacatgtaccctaaaacttaaagtataataataataaaatttaaaaaaaaaaagaaataaatggtggttctagttagtgtcatggttagggaaggattgcacagatactaggttaccaaaaataaaatatttgttgagcatatactagatgagatgccagtgctgtttgataaaatagcatctgatggttagatataaccatgaaacactggatataagcattaacacttctttttgctattcaacaggtacattattccatctttgcagaagctcgatgctgggttttaccgctgcgtggtgcgaaacagaatgggagcactcctgcaaagaaaatcagaagttcaagtcgcatgtatgtgtacagtaaggagatgtccaaatgttaaagaacaaagtgtcgctggggagtcaatcagaatcacttttcaccattgtaggaactgagagtttatctttggttctattttgagtagaataattgcaaaactcagtgagagataagtaagcagccagcgtggctggccaggtgaggggctgttgaggcaaagggcacttttcttcatttgaaaagactcaggaccctaagaggccctggggaggacgaaaaagtgaatggggtgccttctgttttaggaatcagctgctcttagcttgtactatgtttggattcaaaatgtttttaaagtataaagttcaacccaattaggtcaaagttcgtcattgtcagttctttccagtgacgatttgtttagaaatcatgctgcaccacaaaaggtacatggatagtgagcgtccccgatggcattcatgtgatagtgatttattaattctttattcagcagatccattttggagaacgaaacttttaaaagtaaacaaaggagatatcaagaatgcaggaagcttaaattttcatgtagtcttgaggagaaacaggagagcgaacttggcctatgaaagtatttagtcctttttctaattcaaaatctatgaagagtaaaaatggactgtctgctttattttatgtacatatgtgtatatataatagagacataacatatataattatatgtcatatatatgttatatatataaataaatatatgtttgagatagggtctatctctgtctctcaggctggagtgcagtggcacaaacatagctcactgcaagcttgaactgggctcaagtgatcctccctcctcagcctcccgagtagctaggaccacaggtgtgtgccaccatgcctggctaatctggctaatttcttttgtttttggtaggggagggatcgcactgcattgcccaggttggtctctaatgcctggcctcaagtgatcctcctgctccatccagccttccaaagtgctgggattacaagagtgagcttggcttgttttactatattttgaatgtattaccaaaatttctctttgtttaaaagtaagcaaaaaaatgttataagatgttaaattacattttaatatatcattataaactttagagaacaaaagagctcctgagttgggctgtactatttggtgatgacagaatttcctcatttgtcattttaaccccaattaagtcttgtagctttcagtgtgagtagatgaaataaaataatatctagttattttaccataagcctaatgactgagtgaagtggagatgctatacatgtttgatgctttttaaaatcactaggaaggcttaaatttttctaaattgtgatgccgaagaatgttgcagaataattgagaacttttattcaattgaatgattgaaaatgtaatcattaaatagagtgaagacgaatacctaaattatattttaagaagagcttcaaaattattaaactctgttttataaaactgaattttgcttaattatgtttttgtttctgttctgtatctctagctcttcaatttttttttttcttttttgagacggagtctggctctgtcacccaggctggagtgcagtggcacaatcttgactcaccgcaacctccgcctcctaggttcaagtgattctcctgcttcagcctcctgagcagctgggattacaggcacccaccaccacacccagctaatttttgtatttttggtagagatcgggcttcaccatgttggccaggctggtgtcaaattcctgacctcgtgatccacccgcctcggcctcccaaagtgctgggatgacaggtgtgagccactgtgctctgcgtttagattttttttttttaatctttcttttctcctttgctttgataacaaatttcattttcttttgaaaaaactatgagtatttttctaatctgttttgttggtttgtttcatcttttccctcaagtattagacactgtcacatagaaaatgtcttttgactgaagaagacattgataatagagcacttctgtggactatttcaaacttatttatgtttaaataaaaatacactattttgccatatctgtttgtatatatatttacatctgaccataatatggaatcttattcaaaattttcaaatgttacaaattttaaaattagccttttatacctacattctaatagctatgttttgtcctatgaccccattttttaaattttttttatcagtagaacaaatactggaacaaaagctagttgccccagattaagtcaacagtatgagagtgggagaatagtatatagactcttcagtggttaggaaatattgctcccaaaagatctgtgcaggagacagtgacctcacaaatgaaggaaacaagctgaagagagcaagggccggtgccgggctggaacgagtttgaaagatttaggagctaggagatgtctggacacattttctgacagtttctgagaaaactgcttcacgtggctctaggatggcttcagcatttcatttcagtgtcacagacagttgcagacatttccttgtattgtcaggtaggacaaagaccatgtggctttgctgaggaatgtgcagcgtgggcgctttggaggcgcgtggcttgcccggtgcttcactcgcaagcagatccgcgttggtcagcgctgccgtgcagtctcgctcgtcctggtgtgaaatgtggcagcatcagtgactttactgtaacacttacctgtttccatctgtgaccccttccctcccccaaaaatgttttctagaacttgaaagcacttctttttctctgcagatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatgtaagttgctccaaacgttaaagcttcaaatacaattgtaatgtcacttgctggcaccatctacacagtaagtgtaccaattaaggttaccgatgatttaaaaagagcaaactagtctaggagtcctatcctaatttttaataaacagctatttgaggactggcttgaatatttttaaccagtttaagcaaataactgtctaatattattcttcagaatgttgcatgccctaaaactaaagcagccttacccaactttgcagtccatttttttcttttctgagtgtactttttaagatgtcattgtcatccctgagttgggtttgcctcctagtactaatttaatgagtgctggtatttacttacagtgctgtggggttttttttccccctccttttattgagccatgtttgatactgctttctctgacgataaaacagtaattactgcttatttctctttatccttttatcctaccatgacagttttatttctcttcatctaattagtggttcacccatctattgcagaatagttgctttgtgattagttaggcaagaacatcttgaaataatgcttatctcacattcaagatatttatctaatgcccgacaggttttcttcacttggagctttaagtgattaaaaagaacacttggtatatatttcataactggacattttacaacctaatttaaagacaatattccaaacataaaggtttcaaggctgaacatttccagaagaatcatgaaatgctataagcttaggccagaagtcagatatttatgccatccagtggttgcactcagataaaaattcatcaggagcaaatactattgttgtgctttttcaaaaagaatatgtgtgaggtcatttgccaaatagattttacatctaactgtgaaagtcactgtgggaacccacctgctctctcccctacctgagcatctgtggaatcccttcccgaagccttgtgattctcatctccaaccctacctgagcatctgtggaatcctttcgctaaatctcatgattctcctctccacccctacctgagcatctgtggaatcccttcctgaaggctcatgattcttgtctcccacccctacctgagcatctgtggaatcccttccctaaacctcatgattctcatctacctgaacatctgtggaatcctttccctaaacctcgtgattctcatctcccacccctacctgagcatctgtggaatcctttccctaaacctggtgattctcgtctcccacccccacctgagcatctgtggaatcccttccctaaagctgttgattctcgtctcctacccccacctgagcatctgtggaatccttcccctaaacctggtgattctcctctcccactcccacctgagcaactgtggaattccttccgtaaacctcgtgattcttgtctccacccccacctgagcatctgtggagtcccttccctaaacctggtgattctcctctcccacccccacctgagcatctgtggaatcccttccctaagcctcctgattctcttctcccatccccacctgagcatctgtggaatcccttccctaaacctcatgattctcatctcccacccctacctgagcatctgtggaattccttccctaaacctggtgattctcctctcccacccccacctgagcatctgtggaatcctttccctaagccccatgtctccagtcttctagttctggaccaggatctggctggaacctaaataataataattattattattactattaataattatataatacttataattaataattattattttgagacagagtccctctgtcacccaggctgaggtacagtggcgtgatctcagctcactgcaacctttccctcccaggttcaagcgattctcctgcctcagcctcctgagtagctgggactgcaggtgtgtgtcaccatccccggctaatttttgtgtttttagcagaggtgaggttttaccatgtgtccaggctagtctcgaagtccttacctcaaatgatccacctgcctcggcctcccaaagtgctgggattacaggcatgagccaccacttaagcttatttcacaaatgtttctattttggttattgggaacaaaaatttatatatatatatatatatatatgcatgcagcatattttaaaattctagtaaaaataccagttaccttagaagatgggataattgctatccttttttctttatttaattacaagttacttaggtatccacctttatattgattccaataataaaagatgcctcgagtttcgatgaaacaaaaatgaaggatcaatttttcattcttagtagactgttaggctttaaaaaggcaggtaagggccatttgcggtggcttgttcctgtaatctcggcactttaggatgctgattgcttgagtttaaagcaatctggagtttaaaaacagcctgggcaacatactgaaaccttatctctactgaaaattaaaaaaaaatagctgggtgtggtggcacgaacctgtatttctagctatttgctacttgggaggctgaggtaggaagatagcttgaggccagaagttggaggttgcagtgagctacgatggtgccactgtactccagcctgggtgacagagcaagaccctgtctccaaaaaaaaaaaaaaaaaaacaaaaaacaacaacaacggcggggcagggggtggcaggcaagatacattcttgtataaatattctagaagtttccagtgctgaccacagtatgaccaggcaaacttaggataaatgttgggggagaattggtaccagggatggggggagttagattgaattaggctttcctctcaagcactggagcttttaattaacgtcagtggcagcaaaattcatggtggaagaattctttcaacttagcagcaaataagtctgtattaatctacctgttaacctgtgttctcactatatgcatgagacagcacttattcacgagtatgacagggtatagaatgaaagaacttaatttcataaattttttaaacttgcaaatacatgctaaagcctgtttaattcctggtgagctaataaagtaaagatgctagaagggctttaacttggtgtaatatcaaacaaatggtctgcttacaagcatgaagctgttggtaaatctctaatctcaggaaaataatgcagtataccattttttaaagagatgagatgaggctgattatggatatttacacttttacaaggccctttagtttcgtattttccacctcatcatcaccccaagtctattaagtacctgctgtgcaagattacataaatcagtatggatatgtgtttttctccacaaatttatacatcgtccaaagacatatagctttcacatcccaagtacactgatttgatctttacaaattatatgaatattaaatgatcacatgtaccctgaaactatgtacatctattatgcactaataaaaagtttacctgtttaaaaattaaaaaatctagatgcgaaaacccaatatattgctttccatgtctaagaaagtacagtttttgactgaagatgggagggtatctctgcattcctcgcacccacgggattggtagcacaagtcagatggcatcatatttgttatatacccacagagatgccatttaaaaactagagcatttgactcaaggtgcttcccacatattgaaatgcaggtgaagtttctgcacctattttttttttatttttattttttgagatggagtcttgttctgttgcccaggctggagtgcagtggcccaatctaggctcactgcaacctctgcctcccgaggtcaagcgatgttcctacctcagcctcctgagtagctgagattacaggcgcaccccactatgcccagctgatttttgtctttttagtagagatggggtttcaccatgctggccaggctggtctcgaactcctgaccttgtgatccacccacctcggcctcccagagtgctgggattataggcgtgagccaccacacccagcctttctgcacctatttttaacctccttgtgtgagtttggttccctaatacgtgcacctttgtcatgtggtgaaagcagttcattttctctccccacctccatgtttaaacattacctcattatctgcctttaaaatgtgggctttaggcttataattaaatgattttttttttcattttcaagggaaacagtaagtctaatgttttctaacttgaaaaataagttgaatatcctattaataatcttaacaggagctattatttattgagtacctactttaaacatatcttctctaatcctcacaattgccttctgaggcaggtataattagctctatgtatagttatcagaatggaagattatggatgttaaattacttaccccagggcccccagccaatacacacagagccagggttcacacccgggtctgcctgacactcagtctcatgctcacttctggatcagcctgattctttccactttattggctgataattttttatgtttttgattattttttccatacattgctctagtctttctcatcatttagaagaccagctttcaacttgaaaagacatggattaacctgggtttgcatagaggggttgaaaagtgtcagaggctggtatgttttgaaagtagagacaatctacaattatctcagatactatgtttaattaaaaataggtggaaaaggttaaataccttatgattccactcacacaagataattagagtagtcaaattcatagagacagaaagcagaacattggttgccagggacttgggggaaggagggagtggggagttatgtttaatgggtacagagtttcacaagatggaaagatgtgctgaagatggatgatggtgatgatcgcacaacagtgtgaatgcacttaatgccactaactatacttaaaagtggttaaaataattaatcttaggccacggatggtggctcacacctgtactcccagcgctctgggaggccaaagcaggaggatggcttgagcccagtagcttgaagctgcagtgagctgtgatcacgctatagcagtctagcctggatggtaaagtgagaccctctctctattttttaaattatattttaccacgattttaattgtctttttttttccaaaacaaaaaataacgtcttccaaagacttcccactgtgtacagattaaaatccagattccttcccacattctggggctacagggccagagtctcttgcagtttagcaaatacatcaagctcttttctgttttgaaagttggagacagtcttgctctgtctcccatgctggagtgaagttgaagtggcatgatctcagctcactgcaacctccaactccagggctcaaatgattttcgtgcttcagcctccagagcacctgggattacaggcgtgcgccactatgcctggctatttttttttgtatttttattggagactttgtttcaccatgttgcccaggctggtctcgaactcctgacttcaggcaatccacccgcctctgcctcccaaagtgctgggattacagaccaccgtgcccggccagttttaggtggttttgaccacctaaaatgtttttgtttttctacctacatttggcctcttggtatgcataggagatacacagtgctggaatggctggatgaatgaatgtgaagaaaagtcgtgtaatgtccacagacatcttcagcagaaggggaaaaaaaatgagaacaaacctcaaggaaaaacgctgttgatgaggcagaaaaaatatcttggaaagacgaacagtatattgagagaattgaaaataagttatattcagaatttgaataggtaattacaggttttatctgagaagttgaaaaccccatacatttatttttctgatttactgagtccaaagtttgctatctttgcatatcaaagatgagcttagctttgtcatataaatacagtctaatttgataataaaattgttctgtgttattttggtttagatatattttctttatttccatttatttctcaaaatatgaaatgtgaatatcgatgccatgctgtacttctctttcctccacgacgttatttatgttggtagttatcagattagaacacaaaatcttaactctgtacagtgccattcttgtgcttaattgcaggttcttgtgctcaaattgcatcctgtagcctacctgacaggaatgtgcaagcacaagtattcttgaatgtttttttcctggaaatgcaaagtttatagatgaatgtttcaaaccttcagtcagctttgcaatagacaacttgccagtaatgatctggattgtgaagtatgggcagtaaacagcatcccaggtgactcagaaacagtctgattcataattgtccatgcttaaatacttgaacatccattaacttattaccatttcatttcaatttcttcaagaaagatttgtttaaattagcgcttgcattggaagtcacaacttaatgctcgaatgaagtagatctggttgtaataatgtttttatagttaactaggctttcaaaataatgtgcttttaaaattttatattttataggcattttgtgaatgtttatagagtatatgtgtgaaccgagccatatttggtataagtaaaacagacgagtagatacgggttccaggcctgctttcaccgtaattctgaccttgggaaaattacttattctccctttgcctccattttgccatgtcgatgaaaagggttttctaatcacttctgcaatcctttctggtattaatgttcagtgctgctgttaaggaagggggtgccatggcagttgttcttcccctccctctctttcttccttcatgcatccatggacatttcctgagcacttaattagtgccagccactgttctgcttgccagggacagaaaggggaattgaggcatcccacgtgtgcccctcagtgggtgtgttctgatatgaagcaggtaatacacaggacactttggggtgagggtcgtgctgccacgctgagaagacatggatgggtgggaagagagtcctaagctggagggggttgaattgagtgactaaggacaggtcctctgtggaggtgacattttaaaaaacaccttatagagttataatttgtatataacaaaatgcgcattttcaaagttcatagatggatgaatttcaataaatatgtgcacagaagaaattgccatcccaatcaagagagttcgtgggcccctcctgctgttggtatgcattcctgcagctctgccctcctgcttgtctaatttctattactgcaggctagatgacctgctctagaatttcacacaaatgacatcattgaatatgaaatcctttttctagcttcattcattcaacatcatttctgtggtattctcaatgtgatccttaataataataataattaatgatttttgagtgccaggcactgttttaaggattttatttataacaattcacttaatcttcacggcagcccagcggtttagtactgttattatcgtggctttcctgatgagaactaaggcagagagaggccagcagttggccggcgtgggagccacttgactcctaagtccacaccgttccaccgtgtatatgaggctgttctcccaggttaatgtctgcaagatgggaaggagccagccctgtagagccccagaggatgagtgttctaggcacagaggccagaaacagaaaagagcttgatgtatttgctaaactgaaagagactctgaccctgtatcccctgaatctgggaaggaatcgattttattctgtacacagtgggaagtctttggaagaggttgctattttttgttttgaaaaaaaaaaaaaggcaattaaaattgtggtaaaacatagtttaaaaaaaatagagatagggtctcactttatcatccaggctagactgccatggcatgatcatagcccgctgcagtttcaagctcctgggctcaagccgtcctcctgctttggcctcccagagcgctgggagtacaggtgtgagtcaccatccctggcctaagattaattattttaaccacttttaagtatagttagtggcactaagtccattcacagtgttgtgcaatcatcaccatcatccatcttcagcacatcttttcatcttgtgaaactctgtacccgttaaacataactccccactccctccttcccctagtccctggaaaccactgttctgctttctgtctctatgaatttgactactctaattatcttgtgtgaatggaatcatatggcatttatccttttccacctatttttaattaaacgtagtatctgagataattgtaggttcacatacagtcaaaagaaataatgtagggtgattttatgtaccttgtagctagttttcctgagtgttgagatcttgttaaactgtgttacggtatcacaaccaggatactgactttgatacatcaacaaacagaaggtttctgtcaatactaggatttctcttattaaccttttatggccataactactttcctcttgccctcatccccttcttaagccctaataatcactaatctgcttttcctttctaaagttttgtcatctcaagaatgttgtgtagacagaatcatgcagtatgtgacctgtggggattggttttttttttttttttaacttagtataattccctgattcatccaggttattgtctgaagcctagttggtttcctgttgttgttgtctagtgtttcttggtgtggccataatgtgtagtttataatcattcacctgttgaaagcaatctggattgtatccagtttttggccatgatgaataaagttgctataaacattcttgttccttttttctgtgcatgaacataagacttcattgtgttcatacacacacatgcccaggagtggaatgactgggctgtatggtatttgcatgtttagttttagttttttttttttttttaaatgccaaactgttttccagagtggctgtaccattttgtaatcccaccagcaatgtacgaatgattgcgtttccctgcttcctcactagcatttggtgttgtcatgattttttattttagtcattctcataggtgtataatgatatcttcttgtgtttttaaattttcacttctctaatggctaatgatgttgaacatctcttaatgtgctgattttaaaaagaatgaaattagaaaaaagcaaacttcttgttgtgagaaatgtgttcatttatttgaaaagtcagttgaatgggtgaaagagcagacaatatgcagctaaagtgagacttattgttctgatctgaagaaattactcagaataaaacacagaggaaaaaatatggaaaatctagaaggaaggccaagagatctagaggacagagtaatcaatagacgtccgatggagaaaatgggggatagatactatgcagagaccaatgctatgacgtttcctaagatgatgactcttcacagtccagaagcagaatgagctccaagtaagataaataaagtaaatccaaatctatacatattatggtgtaactgcagaacatcaaagacaaagaagaaaccttaagacaaccatacatgtaattcaggttgcctcagaggaacggcaatcagaagatagctgagagcagtaatagagaacagaggggaatgatgtcttcgaacgccaagggatggaactgctgccatggagttccgtgtcagctaagccaacgatcccaagtcggggagacaggacggtattttcagacaagcctgagaatttatatttccgagaagattgctgaaggatctatgaatgagtttgaggaagaaggatactgaatctagaaggcaatgcagggttagaaatattggcctccgttttatgttctctagttaggaaatatttagtaattggagtgtttaaatatttagatattagatgaggaagtggagacagcaagttgagacaactctttgggcatttttcttgtgagcggctgcagagaaaccgcgcgtgtctctgaggacacgaagtcaagagagctggttttttcttaccatgggggatcccagctattatttatgtattaatggaagttctccagtagagaaggagaatgtgaagagccaggagagagtgaggatgccagggggaacaaagtcctggcaaatgtgacctggacatgcacagacaagcctgggaaggagggcctggagtcatgtggcacggccttcatggtggcatgcggtggcccctcatggcctcacagcttccactctaacaggacggagccagaatatgcgcacggatgcatgtggtttggtaaacgtgcttgtggaaaattgagagatttctcgtggatttttattttctctatgaatatggggatgagtttagaagtttagagtgagggctggtgtgagaagagagagtattaggttatcattcagacagtcagaagcgaactagggaaacatgccagacttatggggacttttgagagcaagggcacagttgcagtttgtggtgatggatatcttcagtaaagtttggaagttctgatgccactgtagagaaggcagctgattgggttcacacaaggttgaagtgtagcctaactaccatgtggaattcagaagcgagggtcatgttgaggctgtctgcaagggagtgatgagtctcgattgtctccgagctttataagagaggaggtgaaggatgttccagtaggatagaatcagaagactgcaggagtctattgactggaagaataattgcagtgggcaaagaagtgggtggactgagcacctcacgtcctctcttcctcactttggctattccattcagtgccaaacagtggacttctcccccacttggaaggaatctggtgacgcagatgagaaaagtcgcaggcttaaacttgtgtggggtgagcttgaatccttagggaatcagcgaatgcttgagtgcaggtggatcagcagacagattactgacgccaccccagctgactgttaggtgacacatagcttcgtgcagcctctctgaagtcatcctgtgggtcacccctccttcctctgtgctttccccttccctcctcactccagggtccacgtgtaagctgttgtaggcgttctgttttcttgaaaaactcggttgtcacttggggtatttgaaatctagacttagaatggcacttttgttgggattgacaaggtttagggagagaccatgaggatgggggccaagattgcatggaggggcagatcagtggtggtgagaagtgtaagactccaaggccacagtgttagagtagatggtaacatggatgtaaagccaccagggagggtggcaggagaagccagtggaggaaggtagggattccagggctacagtcctcaggaaatggagagggaaggaggaattagaacctcagtagggaacagcattgagaataaacgcatcccaatcacatgggcctcagaggaactgggatttggaaggtggaagaggagaaacgggttgggagtgctggctcacagctgtgatgagggtttgctctagctagactagacaaagtgaaggccttctggagctgctcctttgggtatttggctgcaggaccttgcagcttagaatctcacctagtgggtttctgctctgttgcacttcagcttcacttatgaagcagagaggatgatctcttcctcctggagcagttgtgagatttaacagaagagaatgagcaagaaagtggtttgccaagtaatgttcagagatggagagtatatgctatatgccgcccctcaaaaaaggtatgcaggggtgttcaggtaaaaaacgttcatctttctgtggctctctggctggcagtgcacgtagctgtctctgtaacttagagaggacgtgggaggaaggaccctggtgtagagaatatgctggagccatgggcagcccctgtgccccaccgtgcttctgtaaatgtcacactgctcctccaaatgctggtttgtaaaatctagaaagttcttttcgttgttgttctcaccacatccaggaagatggggcacagcgggagtccccttgtctgaactgctcttatcctggggcaaattagtgtccctcaacgtgagtaagaagatggaaagcgccacattgctttcatgaatagtctgcagactgctgatgagctccctgtcaccgcgctttattccagagcctcaccgtgcagagcgagaggtggactccgatgcttgtgaggatttcgtgttttctttcagattgtcaggtagtgcgataaagggttaccttataagcaataataggtcaggatatgggctgttgcccacagtaagtttgacatctacaccatcacatgacgcagttggacttaatgaaggtcactcaagtgtcttctcttttggtgatgcttgttgggcacctgtctgcaggtagatgacactgtccctgctgcttcaggagaaagggcacatcacagatagagaaacgtttctgtgccaagtgaatagcccaagagcatgggggatggggatcgtagaattgcttggttccattcgagttggccatgtagtatctaacttaaatgacaggagtttaatattctatgtaccaatttttcactggaaataaaatacttcatttcacatgagcatatcttgtgacaataatgcatttctttaccaatattagcccattatacatctgaagtcagttgcacataattgcagttcaccaactctacataatactttaattaaaactaggataattaaaatacagttttaatgaacaataaattctgaagttgccaggcctggaatgtgttagttgaatcatagcttgctttttttttttttggctcttaaatctgtacccacattatattttgaaatggcaatgatcacaatcaagaggcattttaaatgcatataatagtatgtactaaaggccaggcaggtgactcacacctgtaatcccagcactttgggaggctgaggcaggcagatcatctgaggttgggagttcaagaccagcctgaccaacatggagaaacactgtctctactaaaaatacaaaattagccagacgtggtggcgggtgcttgtaatcccagctactcgggaggctgaggcaggagaatcacttgaacccaggaggtggaggttgcggtgagccgagatcgcagcattgctctccagcctgggcaacaagagcgcaactgtctaaaaacaaaacaaaacaaatatatatatatatatatatatatatatatatatatatatatatatatatatatatgtatgtatgtatataaaatgtgctagtaaatcatatctttcctatggctgtcttatatatctgtctatccctcttacatacacttgcttatttgctgctaattgtaatcccagaaatgaggaaaaggttttatttttgaaggcccagcaacttaaaacagcacctggtcatactaagtagtgaatatttattgaacaaatagataagtgtttcttggatgaatatataaataatagcacatggtttgttctggggagatggtgtgagactaagtacactagatcgagactcagaaaacaggtttcagtcccggccctgccacgtggtcgctgtgtgaccttgggaagatcagttagctattctcaaggaagttgagataagggtatatatcaaatggaaataatgctggccacctcaccagtgtctgggaaataggattgggtgcgtttatttgataaattgaatatacatgtggaaaccctgtctaaaccgtgaagtacgcatggtgtggtgggattgtgaccccacctctgctcacggtgttctccaattgtctacatgagcacacattagtattcacagccagctgtttctcagctcatttggaactttgtatgttttaggtagtttttgcataatgaattttcagcccttggttggtgataccttgtaagtagatatgccccctccatccttcccttctcctttacttccatcccatttgtaatgtccttgggaaactcaagtgagtcccactgctgttggctcctaagagagacatttttgctgcctgtgtatctgctagatagtttgtttcacagtcaaatataagtgacttttactagcttttttctggactattagtgtcagtgctactctccccaaacacaggtcatttgttcctctgacaaatacctccttgcactgacattttcttctggaagtcactcccgaagtgcaaaattccctcaaaagcaaatgtactttggactctaagggggtactgctggagtcaaaaattaagaaaactttgtaatgctgtttaattcatgacccagacccagggcagggtccttaagagctgcttctggtgacactgcaggatacatctcacctgtacccctgtggaaagccaagggtcagtgggactcaacccatacatgctccttgggaactctctctcatgacaagcctggtcttatctggtcttatctcagggtgttttggtggaaatctttttttttttttttttttgagacggagtctcgctctgtcgcccaggccggactgcggactgcagtggcgcaatctcggctcactgcaagctccgcctcccgggttcacaccattctcctgcctcagcctcccgagtagctgggactacaggcgccggccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccttggtggaaatcttgactgtcaaagttaccttctcccccacaaaggaggagggggaaagctgccgtctagaaggaaccctagggagaaagggatgtgcttggaggtcaagaagagtcacagggtgtgtgtcccacccagggcattcgtgcaccttagggctggggccatgaggaggctgtaaactggaaagatcaaggcagtcgtacaaagacagggcaaaacatgctaaacagatgagaggcagacagctgcagctgtctggaggtgctgtcacagttggcacccagtgtctacagggtgggttccctctttgtggaaagggaggtagcattcccgggtggggcacagcacaccctgccgagtcctggaaagagggtgaggagcgtcactgtctggaaattcagggtcctacccaaatgtgaagtgtgtggaggcagggtggtgtggaaggcacactggatttaaagcaggaagagggactgtgagagccagctgtgctctctcgtcactttctgcctgtgagcaagcctgacttaatgtttaggggactcgggtttttttccacctgtgaaatggggtcaagccatctgtttggcctctgaggaggtgtggaaggagctggccatcctcaggagggggacattcctggaggcagggccaggcagcgtgcagcctatgcagatgatgtggaggcacgtatgtttttcttatctttctgcgagactactctaaatcttcacgacatgctagtaaagaaagcagaggaagtcttatcacaccaattttgtggatgactgcagggggaaagaaagtggctaaatgatataaggtcaagtcatctgtcagacatagagccgaggatggaggttggcatttgaatgatacctttgtcatcattttcgtgaatgtttatgacaaagtgggtctcagcctgcccatgagggtggtgaaatggccaaagggtcctgcacaggccttgggccccgtgatgcttggtgtctaaaggcaagtgcccgacttcggtggggctccttctcttcatctgtagagtgcaggtgataacaccctggcttgcccgcctcacaggacttttactttggtgcgtgatgatcacatcccctcacaggtgttaagagccctttgtgaatcatgaactgtcatagccgtgaggtggaatcattttctcatgagggcccattctttgctgtaatgagatctgaccaagcctggttctgtctaattcctacagcatttgcttccaagtgacagcccctaatatcgaggtcatccttcatttattctttcctccagtcaatcagtgagcactgtgctaggctctgcggataaaaagatcaatacaatgagtctggcttctgaagggctcacattctgctgagtgggatacagccatcttttagttcatctcatgtagtctttaaggaaaaaaaaaaactttattgagatgtaatttacctaccgtaatgttcacattttcacaaaagcacctaattcagtggtttttagtatattcacacggtagtagagctgtcactactatcttcttttttttttttttttttttgagacagactcacagtctgtcatccaggctggagtgcagtggatcgatctccactcactgctgcaacctccacctcccaggttcaagaaatcctcatgtctcagcctcctgagtagctgcgactacagacacctgccaccacacctgactaatgttttttgtatttttagtagatatgtggtttcgccatgttggccaggctggtctcaaattcttgacctcaggtgatccgcccacttcagcctctcaaagtgctgggattacaggtgtgagccaccatgcctggcccatcaccactatctaacagaatatttccatcaccccagaagaaaaccctgtaccccttggcagtcactcatctttcttcccacttctcaggcctggcaaccacacatctacttctcgtctatatgaatttgcctattctgtcactacctaacatgtgaccttttgacaccttaaatagcctttacccagttgtctttttcgctttctttttcttttgtcctttactgatcatcattaaatatttcaccgggttcttttttggtgcctttcctggactacgttctgtgggggtaaagaagggacattccttctttccttgaatgtatgcttcctgaatgtcagctgccctggtcggtactggtatgatatcacataggttcctgttctcagaatttccagcctggtaaggataaactgaccaaaaaatgggcaaaaaccaaacacataaagaaagtcaggtgatgaaagaaaaccctgtccacagatataatatttataccaaaatttgaagaaagggaaggagccagcgacttgaagaaatggggctggacatctgcgtttagtgtttgcaaaggagctcaggtggcagagagcctggtgtgttccaaggccgaaagggggcctgtgtggtacattctccgaggagagtggcccaaagtgacgtcggcagggactagattgtgctgggttttgtctgtggaaacgagtgaattttctccacgtgtagtggggtggatttataccaggagaaggccatgatctgattggctttaagaaaaccaggctgctttgtgaagaatagagagtaaggggcagaaggagaagcggagagaatacgtaggaagcttctgcaaatgccccggcaagggggactggcagcccagatgaagacagggtggatgacgtggagaaaagtggatgaatgaaagtgtaggttaaaagtagaatccacagggccaaaagagggatttgggatgtagtggagttaagcttcttgcttctgattagagcccttgggggaatcttttacagaaatgatgacaactggattcagatcggatatggggcttgttcagtttgagatgcccgtgaagtatctggtgacaacaattaaccagatgtttgtaaacacacgagtctttagcttaaaggaaagatcagaccggagacagaatattggggacaatttgtatgtaggtgatatttaagaccttggaaatggtgagttcttgcctgcagagagatttcagacacagcaaagaagagaagcaactgctgaggagctctaccatgcagagcagggtagagaaataagacacccatgaaaatatggaaagggacagccagaaagggatggggtagccaggagggcccaataccatggaccaccaagaagagagcttttcacctgattctacataagcagcttgagaaaagcttgagtcaacaggacttgaattccagcactaaataagtaaacaagcaaacacataaataaagtaagagatcaacaaagcatagaaagagaatggggaaataggagggagacagaagtggagagagagagaaagagagagagagatgggagagcctatctttccatatcttttgtcaccttttgagtaaaacctgcccataatgggctcagctccgcagccaggttgaaaaaaggtcctgtttcacgccccaacataaccataaattagaaagccttctggaaaaaaatgtgttgtggacagatgagaaagtttaggatcaaacaaccatagcagcactagctcatgcttcacccaggatgatttctcttcatgttttagtgcttggtctttgtcatcgctgacggaactgcactgttttaccttggaaggttataaatggggaggcatccttagaacttatttatctttgagagcatgaatcttttcttcttcaatctagacttgcccattcattattagatgaggtaaattattatatctgagagatacattatgtcctttggtgatatgtgtatactttaatagtcagggtctgtagtttaatgagtgaagcaattttgagaattacctctgctgagtaatttttggtatttagaaattacttatgtgaagcctgtccgtgttcatggtcatttcaacacctatctctcactctctaaaatcattgagaatccgttattgcctactccagtgatctagataaccatttacctgagctttgttgagttcagtattctagctaaaatcctgtatcacaccaagtactttgaacaactaattgactatacataactttattaacttttttcatatatttttaagtaatggttatatgcagagaaaccatggtttggtttgaatctgctatgtatggattaacattgctggattaaattttagttaaatgtaagaattttgtctatggaaatgcatgcaaaacagtacttgtgctaattaaagttggagagaaaggggacattaacaacctgccgttggcttatctctgatcctctgttgtgagtggaatgtctagttgtgtagtaccccgccttcatctatcacacgctatatgaatttaaataagttgtaaatgccctggatttgatttagtcctttctttgatctagtgatgaaataaggaattgtggctatcattgaatttttgaaaagcatctactgattaaaaattttaaaaactgtttctaaattcttagtgtgaaatgccctcggtttagcattttccattattttgctgtttttaacatcttcaggaatatatatgatttggaaaaatgcagtataaaatggtggctaagaatgtaaactcggaaaccaggctgtctgggttcagaccctggctgtgatacctaatagttgtgtggcctcgggcaagcacctgggcttccgggcaccacactttcctgttgtgtaaagctggtgtagtaataacacctgcctcatagcatggctgagggggttacctgtttaagcacgtgcaactctagagggcttagactactacctgggtgtagtaagaccgttattaccattagtggttctgacaactctcattattattaccacttactcaaatgtttcaaatagaggaagaggcaacggttgtatttttttttttttttttttttttggtgttcccttcaaggaaatcttgcagagaaaattgcattctgtatatctggttactttcatcccatctggaggcacaacaattattttcttaatcctttattcgaacaaaagtccaaattctcaataacaataggtaaaatggaactgatggatcagtgttgaaatgggtcctacgggaaaagttgtaactaagttatgcaggtttgaaaggtatcatcatctgaacatctcacaatactcttcaaaaagacatcctgtctggttacacaaaagatggagcatgagcatttttcacagctcagcactgggagccagggacacatctttgcctagtcccctgtccttgcctgatacattagtcctgaaagtgggaaacccatgactgtagacaactctcctagattctgtttgtcctttgaaaagccccatttagcaaggcagagaaggcagtgaggacccaggctgtcttcctggaggtccagagagaagaagggtgctgacaagggccgctgcggggacgattgggagctcacaggcttgggttcggagaaatggttcctctcttaagagcacaacagcaacaacagatgtttcgggttctttgtcttctaaatgtgtctcacagatgtacagtgtttatatacgtatatacaaattatatacaggttgagcatcccacatctgaaaatctgaaatttcaaatgcttcaaaatctaaagctttttgaacatcaacatgatgctcaaaggaagtgctcattgaagcattttggattcggatttcagactttgggatctgagatgcttaacccagtatgcattatgcagatacttgaaatctgaaaaaatctgaaatacgaagcacttatggttccaagcattttggataaggtatgctcaacctgtaatatgtattatgtatatgcaagtatgcatgcatgcatagatgtgtatgcatatatgtgtgtatgtatcaatcagatagtacacatatttgatctcattttggactttgaaggagtgcataattagattattttgtttccatatttgaaaacaaaatctgttttcaatggtaagcagaaaaattgttgaaacatctgttacagtggcaaaaggctctgactcttgtttaaaatgagtaaaattgtgatacttacttttagagtaagatatataatgataatagtacagtgtcctacatcagagaaatgaacatccatgtttttgttttcaagtgggataattgtaggtggagtgtgtaaaaactgaagcttatttcatgcacacatagtatctgttcccttctggtgtttttaactaaatgaaatatatagggaagtgggattcatgcttgcgatgtatcttctcgacttggggcttgttctcagggccttgcttgtttgcattctgtgatgttgtccgcttagaggtttgttcttcagctgagggacctgaacaacacaatgatgggtaagatgagagagattgctgtttagaccatgtggccagagagggggacagtgtgtgtgacatgcagggtaatcacctcattctggtttgtccaggactgtcccagttttagcactgagagtcccctcagtccctgggcaaaccgagatggctggccaccctacttgtttatagctactgtgggtataaaacttgccacactagaattatgtgttgtccctaccactgtcaaagtctgtacatctaaaaggaagtatggaaagtagaaaactaaatctaagattagctaactatcctgtaaaggctaagcaaggcagaaaggtttcatgaacagaactgaatttcttttcaaagcatttttcttaggaatgtatcattgtcactgtaggaagaagttgatacacttccatggtatgctaggcttataaatttgagaaaaattaaccacaagatatttccgggcccctaacatctcattttgggtacattgtaccttcactctagtttattttccctttgttctttttctggacaacattcaatgcttgttgaaacacacctgttggaattagcccagtgagcatttctcagtttgccactgggagatatttttctttcttcttggtggaatgcttgacaaaaacatacataccttgaagggagtgtaaagcatgaggcaagtcagaggtgtgcggaggagctccgtcactgggagggtcttgaccatggcaaatgttgcaatgaaaaacaccaggctgttaattaccccacaactcagggcaactccagctaaaatgccattgctttgtggcaaagtataacaagaaactcgaatctgtgtactctggtccctgtatgtatattttcttctggaatattacagcctttttcattgtgcttataaatttgagaactagcatccgggcacagtggctcacacctgtaaacccagcactttgggaggccgaggtgggtggatcacttgaggttaggagatcgagatcagcctggccaacatggtgaaaccatgtcttctactaaaaatacaaaaattggccgggcatggtggcgggcatctgtaatcccagctgcttggaaggctgaggcacaagaatcgcttgaacccaggaggcagaggttgcagtgagccgagattgtgccactgcactccagcctgggcaacagagcgagactctgtctcaaaaaaaaaaaaaaaaaattgagaactagcaatagtctgatagagcttttggtctgctttcaaatctgcatgtgttctaataacttggcatctttcttacggctctgagatgaagaaacattgcctccaagaaacagaaactgttactttcatatcttatttgaaaaatggcaatgattttggaggacagtctgtcattttccagaggaacagatgtgacccatatccacagcaggatgattcagaccattataaactttgagtaggctcttctgaataactcagagatccttgagtttacctgaaagtagagaaatgaattaatgatgtaagtctgtaagaaagagtggactctctggctgttgtttttctgaagcctatgaaacctcgtagatgggcccttcctatgtgaagtaggtcccaggtgtgaatgccctctgtgcctcctcaacaggagacccacacatggggaccaccctgtgcacgcagagcagtccactatcatccccacctacagtgatgccttgagccccctctttcactatattttcccgtggcctcacctacaggaacagtttgagcagattctgcaggttgttaacattagagaaaacttgcatgaatctacatatcagttaaaataatgaatagttcttttagtcctgctctagcctctgctgccttatatcacattttgcaattctttgagggtagggattgatttttgttcacctttgcatctcttgtatacaacacaccatagcacaccacacatattgatgttcaagaagtatttgtttggttgaatgaatggagctttgtcttgtgcctgactagttaataaatatttttatgtttgtttccttgtccttctcttttttgcatggggagggagtgccacagcaagaggcaactagaagtagtatttcgtggtgactgcaggacatgtcgtgccattcattgagcattggtgctttctctcacgtggatcctgctgccatctgcagtctttgtttatgctccccttgccctccaaagtctggagacaaaagtgataaagttgattcatgcttggagtatccagcgttccttgtgttgcttttctctctttattaacagatgtagattgacttagtgatgaagatgtttcctcagttggttccatttatgaagggcagggaaactcagaacaccttctaccatcttcccacaatttctcggttggctcacacttcctattccaattagtcagggggttcactctttcttcctgccaccacctttgttctggccattggcataattctgcttagattcctgcaggaaatctcagctgatctccaagtatccagctttgtcctttattcacctcctaatccagttaaccagatgtttctgaaggtggcatatgacacccccaccccactcacctttaaaatccttttagtagtttccgggcctcaagatgaagttcgagcactggtcctcctggccttgtgccgcctgcatctggccttgtctgtcgggcttgtttctccttttcccttcacaaggcagccacgctcagccttgtacactgtcccagctgccccaggtctcttgtcatgggactttgcacatgccgtccccctgcctggaatgccatcaccatgctggattttacttttagcttcagattttatcttacatttcagatctcatcactttctctgagaccatttcccaggctcctgccctcaccctgctgccgacacacagcaggttcagtgtggtttccctggggtctggcgacacctctccctgttgcaggtcttgtctgccgtgtgctgccatggcttgggccttgcttctctgtatatcataagctcctgaggacagacactctgtatctcaggccctaaaatagtgccttgtgcgtcgttggcgattggtatttgtttgaataaattaattgttttatgcctaatattaattttcttttcataattacctgtcaaagtacatttgtgaaaacaaaaaaaatcaaaggagagacatcctttaatgatgtcagtggtgagatcaggtggtccatgccttcctatctcaggtcttgcagggtggaaacgagggataaatgcctgacgtttccccttgtctgcatctgctatccgtcacaagaggtgttggctggtgcagtcacatcacacttttctaaactcagaattgaagtgagttttttatttactttttttttaaggacttgtgtttggtgttttggggtgttcttacggtttgggaaattttatgctaaggacttgttctttccattaagtgctcctagaagaaaaataaatgacaaaagaaataaaaatcccaatgaattgtgacatattgtaatatgtcttgtgcatatctgtgtaccttggcagattattctgacctaactgtagctaattttcatttgagaaatacatgtccatgaagtttatatagtgtgttcaaatgtaattttattataaccatattattataaaaaacacacatttgtatagagaacactgcagcatctacttattccattattacaatggtaacaccatttattttttatgagtcacttgtagaatgacattttggcaataagtcaatgagtttatcatggaaaagtcttcctcccaacctcctcctaccctgaggcttttctattcagagggaatatctttttcaccctcatgcttaagattcaaggatagaattcactctttttgatatatagcttgatgaattttgacaaacatacagtgttgatccactaccacaatcataaaatataaaatagttctatcaccgcccaaattctcccacactccattgtgatcaactcttcctccaccaggagaccctggcagtcacagatctgttttctgtccctatagttttgcattttctaaaatatcttatgaatgggatcctaaagtatttagcctttgaatctggcttgtttcagttctcgtaatgcatctggtactcatctctttgttgcacatatcagtactttgttcttctttattcataagtagtattttattgtgtgcatgtaccacagcttgttattctattccccagttgaagggcatttgggattgttccagttttggccatttgcaaataaagatgctagaaacattcacaaatatgtttgcacatgaacataagcctttattttgcccagttacatgcttggagtagactttctggtaagtgtatgtttatttaactttataagaaacttataagaaacctcaaagtcctcagggaaataatcagaaacttagcttgctatacctaacaaaactatcatttgaggtaggggacagagggataatggcagttttagacatgcaagccattctcattatgttttactgcttaataagctgccctgaaacccatcttagaacaaaataatcaggtgttttgtacacaaatctgcaatttgagcaggagtgggaaggcttatctttgctccacctggtgtcagctagggtggttccactgatggcagtagattcctcttccaacacgactcactttcatggcaaaagttggtattgactgttaactgagagttcatcagagttaatgaccagagaccccagttcctttctacatggacctctccatgggcatggacttccttcaaagattatatgctgggttccaaggacaaacatacagagagaagctgtcacataaaaactatattgccttgggcctggtgcagtggctcacgcttgtgatctcagcactttgggaggccgaggcaggcagatcacatggtcaagagttcgagaccagcctgggcaagagaccagcctggccaatatggtgaaaccccatctctactaaaaatacaaaaattagccgagtgtggtggtgtgcacctgtaatcccacctactcgggaggctgaggcaggagaatcacttgaacctgggaggcggagtttgcagtgagccaagatggcgccattgcactccagcctgagtgatagagtgaaattcctactcaaacaaaacaaaacaaaatactatattgccttttatgatgagccttgggagtcacaaagtgtccattttcaccattgtgtcactagctgaaagagtcacaaaggcctgcccaggttcaggagaaggagccatagacctgtccctgtgtgacgtcatgggaggctctggcagagcatgtctggtaaggaatgttgctgtgccccatttgaaaaggacaattggccacataagggctcaagaagtttaccacttaccaaagctctttgagagaatctaaaaaggacacattccagggagaaaagtaaatctgagaagaagtagaatattaggagtgataatgaacaaataaggtggtaaaacatattggttagtgtaaatgaatgttgaatattttgaaaagcaaagaaatgtggaattgaaatcccaaattataagagcatggaaagcagtgtaggagcagaggggattaaaaacctgttaaagttactgctttgtctcataaacagatacagaaacagattaactacagaccttgttgcagaatttttatatttggaacatgttcaggttttacagcaccttcttacccccttttcattgaactcttgaagatctacttctgctcccaccaaaacagaatcatctttgagttcttactctccttgaacttcgctggtattgactgttcggtttacttccaccttctttaaccactctcttcttttgaattcaataacacaacacactcctgctcattttttctggctctcttcttcttagacctctttgccaacttgccttcctccacctgtctttaaaccttggatttcctcaatccttggtcctagcacttcactacctcccaccttattctccctccttaggtaagttcatccaagctcatcagctcacataccaactatagcacttgcagatgactcacaattttacatctccagcccacatcactcctttgagtttcaaacctatgtattcaacagcctattcattgtattttcctggagttttttcaaaggtgcttcatactcagtaggttgaaaacagaactcttttttcttcattgaccctattttccctgccttactcctggctctcctttcttaacataaatgacactgccatccaacagttgcccaagcaagaaccaaggaattatccttgatacttctttttctcttccaccacatccagtcaatcaccagtttctcttattgtaccacatgttatcccacaaatctactcacatcattgtgtgtccacctctgccaccattcctgaccaaactcttgcctctttcattggtctctaccttgtttccctatgtttattttgtcttctctctccattccccatgctgtggtcagaatgatatattaatatgaacctgatcttgttactctgttccttcaaatccattagtatattagtctgagtaaccaaatccttaatataaacagcagggtttgtgtaattcagttccttcccttatctacctaaattttttcttccatctctttccctctgacgtccagccacagccactttggtatattggttacgttcttagtttcccggatcagatacctgagtttgaatcttaacttttcacttactaggtatgatcttagacaagttcttaaacaaaacaaaacttttattaatggacaagttcttgaacctatgcatcagtgttctcatctctgaaatgcagttattagtctcagcttcttaggggatttgtgtgaattaaatgagatgaaacgtgtgcggtggtagcacagtgactgacagttaataagcccccagtaaatgttagattatttgcttaacgaaccacctcccttcttgtctctgggaattctcgttgctctccccacttatacaggatacccacccgcttgcttcccttgcttagtactgacttatccttctgcagcaaaggaccttacatcccagctggctcaggacagacccagtttatgtctgttgtagatcagttaacatttactgtttttaggtatccccttttactactggtttgtgaaataaattagatgatcacccttttgtgctcagttcaagagtaaccttttttaggaaaccttctttgattcctacaaggacaggtcgtctattatttgttcttacagcacatcctgtaacttttttttgccatagttaccacgattacagttaaaacagttcattgcataactagttccttgaggtttgtttctcctattgggctctaggcccttggaggactgggacctcaaggcggggggtgtcttgccttacccctgagttttcagcattggtcttatccaagtcattactcagtatatttagaggagacaagaaacactgaacaggatctggtttggacttcgtgtctgtttctgactttaaatgtcaagtcacttcctctcactgtctcttcatttcttcatcttgtaaattcagaaaattaagcttaatgttctctagaattccatcggcctctacattgtgtgagtctagcccatcagggacattttttaaaccaatttttaaatatttatagtcacaaatttaagaaggaaatggaatcaatgtacatctccccaaagacagagtaaaatactttgttgctcattgaatgaagctctggtcattaccctttttgttattatgattcctaatttgtaagctctgatgttatcccttctttctcaatatagctgagacaaatgtgtagtctgtatgatcatatcattgctgttatacctatttacaagtttaagactgagtcaatagaaaaaaatccaagtgaagagtgtttaaaataaacttgtgtttctccaggaagttaactaatcaaacacttttcattgtagatgttgtcattcagtacaaaataatccctgagacagtctcatgaaaaacctaatgcattttttggtgagttttataatgagattaaaaagaaattaagagcaggaagtgaaattataacgccagtgggaaatctttgaaaccattttatagttttttccttcttatgtaatatgtctgtgagattgggcaggtttttgtttgcttgcttgcttattgtttgtgtttataatgtggaggaatcagctgaacttgacttatccctttacaactgatccatgcctacacagtagttgcttggagctaaaagcaggaacacatggaccctgaggcatagctgctctgaagtcctggcggcctctgggagggcttatccatgatatgggacacagggtctcctgaggtcttggaggagttttcctggtaactctgaggagtggcgggtcatggtgtggtgaccattggtctaacctgaaggactataggaatgagggcagggagaattgtagggaggcagccgatgctgctggtgagaatgaaaacatcctcagagtggcttccatacccatcctgtttctgtagtgcccagttattgtgaatacccatcacacgttattctatcacagcaagcagctcatctaccctactgcacccccaagttcttgaagtgtctctctgtttcttgccgttactggaggtaagccaacatgaaagatgaaagctgtgtttatacttctactgcaaactcttgaggaaaaaaacagaggcattagccaaaagagataggacatacaggcaaagaagaaagatgagctggaaaccagtacctaaataagtccaaaagcaatctatttatagatcccagagtgagatcgataaaggagatgatgtggagaaatatatatatataatatatatatttatataatataatatataataatatatattaaatatatattaaataaatattaaatttatatataaatttgttattaaataaaatttatattaaataaaaattaaatttatattaaataaaaatgtaatatatatttttataatatataattttatatatatatatatatatatatatatatatatataaaaaatacagaaagctctaagtatgcacagatcacacttttgccaaaataggcacctacaatgagggccccatccccacccttgagggtttggagtgatctttgggtaaaagctctattctaactcttgaaatggttaaactttttctagatgcatcttttaatattacttcctcttttattccttttttctattttttttaaataagcatctttgctttacttcttttagctatgaagcagctcttgctgatagtaaataaatacttaaagtatgaagatacttccttgtagcatttgaccaatttgtaaggcagcggttcctcaatttcagtgatgcaccaagcttttccgaaaatgagttccaaagggaattgatttttatctgcaatactctcatcctacagacaggatattgactacacttgatagaatggaagtgtaaatccagaatgaagcattgcaggaacaaatcccatgggggcggttcatgatcaacagaatcattcattggacggaaagatcggagagctagacagtgtcaatagagacaaaaggggaaataaaagcattcatttcctgaaagagtcttttcctggaaggtttttgttgactggctcttccttttagtatactctctattcctagttgtttatcagcttatgtgagaaccttaaaactcataatcatttataatcaatgtttaaacatggaaaaataaaagtacataccataggccccgccggcctgttattacatgagtttattaacattcactgtgagatgccttggtatagacttacccctttttatttctgtctcatgttgttttggatattctgctttgctaatgcattaggtagtttcgtcttgctctgcaaagacaaaagctcagtcattgacctggagggcccaaaactgcgccccctgctgccttgtgtatttggtggctggcatagtcagttcattatgtggcaggcaaaagtttgcattccaagggcggaagacatacacattggttttgtttgagaattatatcataaaactgagttctaagtacttcttgaacattgagattattattgatgaactgattataaagtattcttaaatataaacccaaagcaaattttattaaaaataaatagaaatttgattaagaataagagataatttctaataactttttggtaggtgacagcagggagatttgtttgatcatggagtttttaaatgcttttaagtcttgaagtccattaaggcatagaagagagaataggagaaaaaaacatctctgaatggcacagaccgatcacatgttgattgaagcacagtcaatgtgtatactgaaattgtgagtcaagagctatatcactaaaagataagggaaagacagcatcagaaattgactacaacaacgaaggtgtagtgggagataaagttagacgacatgagattcagtgttacagatggaggcaatttgagaagaggcgggtggagtgtagtgagcatggtaatgagaaggaaggagggcatctaccccacgtccaagtccaaagcagggtgggagagacctagagagggctgctagggcatgagtgtcagcaggggaggaccagccttcctgttgagcaagaagaagaaacatttagaggagagggtgacaatacaggggcctttgctgaggctggtctttgagtcacagaaagcacaatggaagtggttaaggagttttggtttggtgagggatgtagtgtggagtaagagctgttcatggctgtttggggattcatatacaggagatgagggatgaattgagattctaagactttattccataaatacggacaaagggcagtgatgtgttgttcagtgtttgataactataactggctcttggcagggaagagccctgatgtgtagctttttccaattttcatggtgtgaatactcccaccacagtgtattccaggtgaccaacatgacgtctttctataaggagttggacagagatccacaagattggctctgtgttcagcacgcattgggtaaagggcatggctggattaatgctggtagactcaagccaatcattaggcaaggctgtgagtggtagggagtagagggcatttggtatccttcctgacccctgtggatagaagcatagtgacctgaggaacaatagtcttcttggtgtgtgggccatataaaaacaagcctgcatcaaattctgtacatgggttagagtttgctagccacggctgtaaaccttctcatgcccgtgagccatctccacgtgtgaatctaacagatatctccaatgttgatctccctccatgccccaaacctgctccacccatagtctatatcatatcatttcatggcagctttatctttcaaatggttcaggccaaaaccttgatctttcacccatagccacagaaaaacctgttagctttcctttcaaaagctattcaaaatccaacatttagctgttttcactgctaccactttggaccaagtgatggtcgtctacagctggaattattataacagcttctggtctgtggtctagtcttcttgcttgcttgtattcaacacttagctaatctttttttagaatgtaagttagatcatgtcagtcttcaaaatcagaaatttccagtttcctgtttcattcacattaaatgctggagtacttaaagtggcctacaaaagtctacataatatgctccccattacctttcttcctccccctactcctttttgtttgtttgtttgtttgtttgtttgtaaagagatgaggtcttgttctgtcacccaggctggagtatagtagcatggtcatagctcactgcggcctggaactcccggtctcaagccatccacttacctcagccactacaggcatttttgtagaaactgagtctcactgtattgcccaggctggttatgaattcctggcctcaagtgatcctcccaccttggcctcccaaagttctggaattacaggtatgccatgccccgtatgtcttcttttgagaagtatctgttcatgccctttgcctactttttaattgggttgttttttgcttgctgatttatctaacttccttttatacgttccttatatgttctgaatattagacatttgttgaatgcatagttcctgaatattttctcccattctgtaggttgtctgtttgctctattgagtttctttttttgtggcactatcacggctgactgcagccacaaactcccaggctcaagcgattcttccacctcagcctcccaagtagctgggactacaggtgcatgccatcacacctggctaaattttgtatttttttgtggagacggggtctcactatgttgccacctggctaaattttgtatttttttgtggagacggggtctcactatgttgcccagactggtctcaaactcctgggctcaagttatactcctgccttgtcctccgaaagtgctggaattacacgtaccacacctggcctcttctagtactttttttttttttttttttttgagacggagtcttgctctgtcgcccaggctggagtgcagtggcgcagtctcagctcagtgcaagctccacctcccaggttcacaccattctcctgcctcagcttcccaagtagctgggactacaggcgcctgccaccacgcccagctaattttttatattgttagtagagacggggtttcaccctgttagccgggatggtctcaatctcctgaccttgtgatctgcccaccttggcctcccaaagtgctgggattacaggcgtgagccaccacgccttgccctcttctaatattttttaagcttgaggtcttatatttaagtctttaaaccatcttgagtaaatttttgtatatgatgatagaaaggagttcaattttattcttctgcatatggatatcccattatcctagcaacatttattgaatagggaatctttactccattgcttatttttgttgactttgttgatcagatggttgtaggtgtgtggctttatttctgggttctgctccattggtctgtgtgtctacttttgtattcataccatgctattttagtttcttaggccttgtagtatagtttgaagttgggtaatgtgatgcttcaactttgttctttttgcttctctaacctcatcttttacctacttctgttccctggacataccaaggattcctgcacctcttggcctctgggatgtttgtttcttatgacttcttcaagaaatctgggtggctaattttgtacttttttcaaatatccttttcttagtgaagacttttctggccaccctacttaaacccttggaatttccaactctcccacagggattctgctctgtgtgcgaaggggtatgtgtgtatgtgtgtgtgtgtgcatgtaggtgtgtacactatttttatttaacatacgataagcatctttggccctggattcttcttttttagatgttaatattgttgtattagtctgttctaacactgctagtaaagacatacccaagactgggtaatttataaaggaaagagttttaatggactcacagttccacatggctggggaggcctcacaatcatggctgaaggtgaatgaggagcaaagtcaggtcttacatgctggcagacaagagagcttgtgcaagggaattcccatttataaaagcatcagatctcgtgagacttattcactaccacaagaatggtatgggggaaaccacccccgtgattcaattatctccacctggccctgcccttgacacatggggattattaaaattcaaggtgagatttgggtagggacacagccaaaccatatcaattgttaaatgtaaagacagtgtttatgaattgaaagattcaatatgtgaatatatattttatatcttaatgtgatcttaagacttactatgttgctgtggtaaacaagacagtgtggtattagtggagggatagacacatagttcagtggatggagtagagaacccagaaatatattcacacatggataaccagctgattttttgacaagggtacaaaactccatagaatctgatcagaggctgatgtccagaatgtgtaaagaacccctacaactcaacaacaacagaacaaacaaagtatttccccagagaagatatacaaaaggtcagtaggctcatgaagagatgttcagtgtcattagtcattagtggtcaaaccacagcaggtcatgacattaacaggtcaaaaccacaattagacacaacttcacaccccttgtaacagctaatataaaaagtagaaaattaacaagtgttggtgaggatgtggaaacagtggggtccttgtgcattgctggtggaaatgtaaaatggtttagccaccgtggaagaccgttggttgctcagaaagttaaaaatacaattaacagcaatttcacatctaggtatataccccaaataattgaaagcagagacctaaacagaccttgtacaccaatgtttatagcagcattattcacaacagcaaaaatgtagaaataatctaagtgtccatcagcagatgaatggattaacaaaatatggtctgtaggtaccatggactattatgtgcccataaaaggcaggagctttgaaaaatgctgcatcacgtggacgaactttgaaaactaatcattcactatgctaagtgaaacaagccagacataaaagaacacccattgtgtggtttcacttacatgaggtctctagaatacgcaaattcataaagtcggaaagtagaatagaagtcatcatggccctggggggagggagagatgggagttactgtgtcacaggtacagagtttctgtttgggatgaagaaaaagttctggatagaaatagtggtgatatgcacaacactgtgaatgtacttaacactatgaaattgtagactttaaaatcattaaaatgatagatttcaggcatattttaccacagttttttaaaaagcaattcaggggaggaaaggtgatcttttcaacaaatggtgctggagcaattgggtatcaacaggcaaaataatgaacctgacctaaacctcacattttatatctttaaaaaaacttaaatgaacaacaacaacaaaatgacaaaacatacgagagatttaaatgtaaaatgtaaggttataaaactttttggaaaacacaggaggaaatcttcagagcctacggattagtgaacaatttttagctatggcaccaaaaacatgatcaatacatgaaaacaaaataaattgaatttgatcaaaagtgaaaacttgctctgggacagatgctgcaaagaggaatgaaaaaacaggctgcaaactaggggaaaatatttgccagccacatgtctttcaaaggacttttatctgaaatctgtgaagaactcctaaaattcaatagtaaaaattcctattagaaaatgggcaaaggaggccaggtgcggtggctcatgcctgtaatcccagcactttgggaggccgaggcgggtggatcacgaggtcgggagatcgagaccatcctggctaacatggtgaaaccccgtctctactaaaaatacaaaaaaattagccgggcgcggtggcgggcgcctgtagtcccaggtactcgggaggctgaggcaggagaatggcgtgaacccgggaggtggagcttgcagtgagccgagatcgtgccactgcactccagcctgggcgacagagcgagactccatctcaaaaaagaaaagaaaatgggcaaaggagattaatagacatttcatggaagaggatatacagatgtcaaacaggtatatgaaaatacctttgccatcattggccattaggaaagcgcactttcaaaccacaatgagatttcacttcctacctatcagaatagctaaaataaagagacagtaacaacatcaaatacgtcgagatgtaaagaaatgggatcagtcctgtattgctagctgctgtgtaaactggcatatagccactctgagaaacagtgtggcagtttgtctaaaaacaaaacatacgcttaccatatgaccctatcggtcacacttcttagcatttatccacagaaatgaagacctgtattgacacaaaaatgcacacgcaaatgttcacagaggctttatttgtaatagtcaaattttagagatttatttgagattagtaaaaaaatcagaaaccactcagatgttcctcagtgggtgaaagagtaaacaagccgtggtgcatccgcagcatggaatcctttgcggcaataaaaggaatgaatgaatgaatgaaccaggcaacgacttggctggatctcaggggcatcatgcttagggaaaaacccaatctccaatctcaaaaggctttagactgtgtgagtccatttatattgcattctcaaaatgactcaattacggagatggagaaaatattaatggtcgcagggagttagagacgtaggagagcttgagaggggaggtgaggggagacggctggatgtgaatttaggtggacagcacaggggatctttgtcgtggtaggacagtctgtgtgttgattgtagtgatggttgtataaatgcgcacgtgataaaactgcataaaactatatgattgtgcacacacaaatgagtacatggaaaaatgatgaaatctaagtgaggtctgggtgttgttccaatgactatgcaggttttgatattgtaccatagttacataaggttttactttgggggaaattagatgaagagtacataagacctttctgtacaattttggtatcttcttatgaattattatttaaaatctagtgattttaaaatacaggtttgcatcttttaattattgtcaagtaactatttgcatatgaatgtcaagaaatggaacctgtggcatctgagaatccctaggtttgttgtctccagatgcaactcctcttcctcttaaaggcaacagctatcctgacttatgcgttagccactttgtatttcttattatttatttatttatttatttatgtattttttgagatggagtctcgctctgttgccaggctggagttcagtgatgctatcttggctcactgcaacctccacctcccgggttcaagcgattctcctgcctcagcctccggagtagctgggactacaggtgcaccccatcaggtccagctaattttgtgtattttttagtagagatggggtttcgccatgttggccaggatgatctcgatctcctgaccttgtgatccactgcctcagcctcccagagtgctgggattacaggcgtgagccaccgcgcccggctgccactttgtatttctttatagtttcaccatctgagtatgcccccgagtgctatagtttagttttttgactttatgtaaatgaaatctgactgtgtgaatccttgtgtttctaacttctttgaacatagtttttgtagcattcgtatttgttctggaaagcattcgttttcattgctgtttaagattccattgtgtgtacaccccagtgagttcattcattttaatgttagacttttcctgatgagatgattataaactgctgctctgacctttcctgtacacatccctggtgtacttgtggacatctttctgttgagttttacctcagaatggaattactgggtcataaaggtaggcaagtcttcaaatttatttttcaaaatgccaatttttcaaaatgattttcttaactgtccatttctttcaataacacttaatgtcttttgacatatcatacttacttacagtgtatattatgtgtctcccatcactaaaatataagctccaaagatcatgtgctttttttttatatttttatcccaagtatctagaacagaacatgggacatagtaggcacataataattacttgttgaatgaatacattgaatctatgaatgctgcagccaaaagatagctttctatttattgattaactttcctttcacatgaattggattagaacaaacagaggtataacatttttttccgaacctcttgggaccagatatgttttagaattctgagtttttatttttcatattttggaaagattatacagtccctatactgtatgtagcccagtatcacaagaatggtctctgagagcataacataatcaaatgttttaatgttctgcagtgaaaagtaaatgggagaagaacagactctaaacagccttatatcagttaaagtagttgtttagttggtagaattttgaagtatctgcctgtcagacgaccagtgaagattatgatgctaaaaattacacatcagcatttacaaaaatggtttacctctctctaccactctgtgagatgataggcaacccaggtattattatacccatttcacagatgatattatggaggcaccagaaaatgggactctcaccccatggcttactaaacagcagagctgacacacaaatcttgtctttcgattctgtccagtgcttttcaactatgccacagttgcttcttattgaggaaagcagcaatttttgagatttgtaaattaacatttccagaggggaagaaaactcctctataatgaagctgtcacaaatcatgcactgtcgtcctggtatctggaacaaagctaatggcagcgttcccacggaggcgctcgtatgcactgaactgtccagggtcagaactcacgtgtctgctgcagagacagtgctgagcccccatgcatggggcagtgagccttcagcacggctggcctctccttcctgtgttcttcctttcttgagaatttttttctttttacatcagcttcatagagctgcctgttatactccaacctgctctcctctctcagaaggggggatctcaaatcaagcgtttggatttacagttttttttttttttaaacagagttttgctttgtcactcgatctgatggagttttgcactgccagatcatgcagtggcgcaatctcagctcactgcaacccccacttcccaggttcaagtgattctcctgcctcagcctcctgagtagctgggactacaggggcctgccaccatgctaatttttgtacttttagtagagacggggtttcaccatgttgtccaggctggtctggaactcctgacctcaagtgatccacctgtctcagcctcccaaagtgttgtgatcacaagtatgagctaccacgcgcggcctggatttataaattcaatagcaaatatttctgagagtgattttcaggcacagtattaccgagcaaggcatttacgctgagtggattgattgggagtgaatgtagtgtgtgcagtcttctttcatatgatatttcttgctttttcgtctgtcttttccacaggtaagctacatgagtgtatagctttgtatctgtggtgttttctgatgcttccccaatgttgataacaggacccagcacatactatgcacttgccaaatacttgcttaataaatgaataattatttaagccttttatctttaaaagataatgcctttcagctctgttaacaaaactggtttagacaataggaagcagacagggagatttttgaggcgagtaggtagttttaaacatgccctgtgagaatactcatcagaggttattataatgatttttatgtaatcttctgttaagattttgttcacttcatgaggacaagaaactcacatatacctggtgcatagtaggtgttcagaaactatttactgagctcacgttccatccaggtggagcagccccgttcctcccaggtcctccacctcacagctaacattccctgcgcctaacatggcaagcgtggaagactctggagggtgaaaggagaggcagctgcctggggaccttgggacttgaggcatgaggtgctggtggttctctgagtttccttgttgccttgttgccttagacacatgcattacacggcacatgtcctaacaaggagctgtaaaaacctctaatctggaactagcaatggacacagacacaaaatgctccaagaacagtcctgtttcctccaggcatagggctgggcaaattgtggcctagtaacaaaaaatgtgttggccactcctgtcccaatgcagccacacaggaatgagaaaagcacccccttcatcacctggccctccagctggtttcagcgggcagaatgaaaggtaatgtgcatctccaccgctgctccactcaagcgttcaggtgctcaagttccgctgtggggtggtggtggcaggcctcagtaggagctgatcctccattccctgctcagcagtgacaggtggtacactgatccctgcaacccgtgcagtctcagcaggtctagcgtggagctaagcctctaccccaactcagcatcaggtacttaaggagggtgagagaagctgtgcaagttaactattaagcatcaccccacacaccctttcagtcaggcacagggaggaactgaccttcagtcccaagctgcagctacaaagcaatgggagtcagcctcccctcccccttcctggtggttgtaaagtgcatactgaagctcacccctcactgagaagcagcaaggggagaggagtcagtgcttcccttttgccatgatagtgttggagaagcccagcataaagctgaacacacatacccagccggcctttatgctccacatccacaatgggtaagcccactaaaaagagatgcataggatgcaaaggtcttattatatcatacccaaaatatgtgggatatacctgaagaccatttatcatacttagaaccagcagaatcacaacttgaatgagaaaagccaattatcagatgctaaatcagagatgaatgtgatgttggaataatctggaaaatattttaaagcagctagtcataaaagtgcttcggtaagtaattttgaattctcttgaaataaatgaaaaaaaaaaatagaaaatcttagcacagaaataaaagagccaatggaaagcagagaactgaaaaatagaataaccaaaataaaatactcattagatgggctcaatagtagaatagagatgacacagaggaccgaatccatgaacttgaggacaggtcaagaatgtagccaatctgaacaactaagaaaaaatagattggacacaacaacaatggacccaaagggacctgtgggacaagactgagaggtaacattggtatcatcagaattcataaggagatgagaaagaaggttgggctgaaaatgtttgaagaagtaatgtttgacagcatctccgatttggtaaaaagcctaaacctataaattcgggaagctgagtgaacctcaaataggataaatgcaaataaatttataccaagacacatcataaataaacttgtgaacattaagttaaaaaaaaaaagagagaaatgagggaatacttataagggcaggtgaaaatgacagcagtcattcgaaactatggaggctgggaggaagtagcaaatttttcaatcaccaaaagaaaagaactgtgtacagcaaattttgcatctggtaaaaacatccttcaaaaatgaaaggaaaatcaagatgttcctaaatgacagaaaggtaggaaaagatgttagcaaacctgtcctattggggaagagctgcataaaatattctaaacagaaataatagaataaaaacccggactttagaaagaaaagaatgttggagcgcagaaaaataggggcaaatataatacacaatcaaacttctgttgaggttcatatgtgatggttgatgcaaaaattgtaactttatgtgctactcagtgaatgtagaagaaatatgtaaaacaattacattttagaagtagaaaaggaaaggaacctaaatggaagtaaggtttctacacttcaaagtatcatatatgtacattgtgatacccatataaccactaagaaaactatccaaaatgagatacagaaaaacgttagaaataaatcacaacggacttctaaaaaatactcaacctataggaagataagaaaagagagaataataagaatataggaaaataataaaatggcacgtttaacatgcatatcaataattatgttaaatgtaacagatctaaatataccaattaaaatacctagatttatagaatgaatgaaaaaaatgacctaataatatactgtctacaagaagctcacttaaagtgcaatgacataagaggacagaaagtaaaagactagaaaatgacatatgaggcaaacttttttttattttattttttgagatggagttttgctcttgttgcccatgctggagcacagtggcatggtctcggcccactgcaacctctacctcctgggttcaagtgattctcctgcctcagcctcccgagtagctgggattacaggcatctgccaccattcccagcttatttttgtatttttagtagagacggggtttcaccatgttggtcaggctggtcttgaactcctgacctcgggtgatccacctgccttggcctgccaaactgctgggattacagccataagccaccatgcctggccaaggcaaacgttacttttttaaaaatgcaggagcgtctgtattaacatcagacagagcatatttgtattaggtgtccagggctgcagtaagaaagtatactcatgggctgtacaaggacacatatgcctgtcactcacgcatacatacattgccagtgataatgtaaaacaggacagtcaatgtgggaaagaatttggcagtttttcataaatctaaatatgcaggtactatatgctgtgttctaaaattgaaagattggttgggtgacaggacacagcgcactgaccctgagttagaaagaagctacgactctgttgctgacagctctgaaggagaaggccaggccaccagcaggaccacatgggatcaggtaatggcaggcaggagctgcaggggacgaggtcagcttatgtatggaaagcatttagttaattttctcaggatccctgtggattggagagttggaataatttcagtaggttccagggcactggggcagtcccttgttgtctggtgcctggccctggagcaactggggtaggcaggtagtggccctggagtgtgagtgcccagtaagggaagtggttgggatgggaacttcaacttgatctgcagctcaagaagggagatctgagtggcttctagccagaatctccaaactgggttgggatagcatcaaaacacacacacacacacacacacacacacacacacacacacacaccaccctgtatcacatgggcattgtttccaagacaaatgaaaaattatgttcacacaaaagtctgtacacaaatgttctttttttttttttgagatagagtctctctctgtcgccaggctggaatgcagtggtgcgatctcagctcagcctcccaaggagctgggactacaggcacacgtcaccacacccagctaatttttgtatttttaggagagatggggtttcactatgttggccaggatagtctccatctcttgacctcatgatccacccgcctcagcctcccaaagtgctgggattacaggcgtgagccaccccgcccagccccatagcatttttattcataatcaccccaaactgaaaacatcccaaatgtccctcagctggtaacagatatcgaaccgcagtccatctgtaatgtgggacgctgcttcgcactgaaaaggtgtgaactgtcgatgcacacggcaacttggatgcatctccaagaaatggcggtgatgaaaaaaattcagtcccaagagatcgcatatggtacggctccatttatatggcattgtgggaatgacagaattatcagagtggagaacagactagaagtctacacgggtcagcaaagcagcggagagaggatagagctggatgcgatcatcagaaagtaacacaagaggtccttgcggtgatggaaacgctgtgtgtcttgactgtgttaatgtcgtatcctgctcacagtgctgttctatacttccgtaagctgtcgtcattgcaggaacctggataaaggtacccaggattgctgtatttttcttacagctgcatgtgaatctgtgttatctcaagagcttagagtaagggaatgagaggagaaacatggcaccctcaaagattattagagaaggttctatttccaaagattagaggatttccaagaggaaactactctggaaaggatttttaattgcatttagggaagccagtgtactaagagctgagacaatcagtgctcagtgtagtaatgatacagctacttcctaactcctttctgggtgctataaagacaaagttaattgtatcattactatttcaaaacaactgaggcttttaaagtgtttcttaggagtgttacaagcctgtctgaagtcctggagagcaatgaagtgtagatccaggaggctgcagtcaatgcagtgtggtggttgagagaccaggccctgaaatcagacctgggtcaaatttcggctctaccagtttctggtcttacgccctttggcaagttagttaatcttttgaggtttaattcttacatgtagtatgagaactgagaagtaataactgtatctatactgaaggagtgttataaagaataaatgagataattaacacaaagcacttcataaatgctctacaaatgccagctttgctgccgttgttagtattataattagaagcaggagcagtagtggtgcagaggaatccagagacaaatttcgtctttgtttctaacagcatgatttctagaaagtcacttagctttgcagacctcagtttcctcatctagagttttagtatgttggagtagatagtatgtaaagtatcttccagtgtttatcttcttggatgctacagtgaactttttagagggaaaatactacagcggctgaaagcacaggctgaggagtctttcaggcctcagtttggatcctgcctccattctgaggcacacaccgctcatggccaatccatgtcctgtgtcctctgccttccttagagtttgccattttgttcagaacagcactgtgagctccctcccacctccccgaccctatgatgaatcatgattgctctaggacaggtcagcagactactgcccaaggggccaatccatccatgttcccaccttctgctatacttgcgttcctgtaaataaagttttattgtaacacagccacccattcatttatgtgtcacttgtggtggtttttccagttctacatgtggagttgagtagttgtgacagggatggaccatatggcctgcaaaccctaactgtttgctatctggccctttacagaaaatgcttgccaccctctttcctaagaacgttatgataaccctgcttctgtcaggtttccagcttcccttgcagctatggggacctgatgattcacctctcccacaaagatgtcagcccgagccattggagcctgctattctccctcctccctgttcctgttggattgtgtgcagttgtttctaagtctagtgcttataggtgtagctaccatcctgccgttataagacagtaaacctggtacaagctaagcagggtggaacagagagagggaggggcctgcattcttgacagacattatcaagttcttgtactggctctggattccctacgtgtagtattttttgttatatgagaaaataatctcttgttttttaaaaaggacttttaaaattatttgttgtggctgcctgtaactaaatgccatccacctattacagactttttactactggtgaaattttgaacaaattatttaattttactaggcctcagatttcctctctgtttcttactttagtaatgaggattaggttagatgaaaaatataaggcttttgctccgttcctactacagaggaagcaaataattggaagttattatttttatttcccaatgaatccattcataattctaaattattttgagtctgtgtctacacaggcccatatctgccaaattaccttttgcaaaaaaccatgttttatttagaaatgctttgacagccagaacatgtgtgtctattgcaaacaaaaatattttcagtttagaaatacttgttttgatcatccgtgtggaaatgaatgttttgtatttgagttgttaagctacaaaatatatttgctaaatgtttttgcaaaaatattcatccatttcttagaataatgccttagagaagcacccagtggtaattatgttcttaggcatgtttatgacacagaacagatcgaaccttttggaaaaatctggaatggaagctgggactaatagcccagtgactctagatgcagggcgtcacctacctcatcacgacgctaatgtttccagggcttgctagttgaatttccacatgacgattagcacaaatccagaactaaatgacaggttatacttctgtctcaagcatcatatgatattgatttttttttactgtaactagaaatttttttcctggagggtcatgagaaaaattgtattttttgacaaaagtataataatttacttgagacttattgttaatgttcagtgatagtggcagggatttatccttttataatccttacattgtttctctttcaaatttttcgtgtagggattataaaaataaacccactggatagcttgtaccttttgctggcatttaggataaagagaaacccaataaatcttgcgtcgagtggcctcactgatattgattgaattataagatcatagtatagcttttacagataagtcaccaggaagacatcacacaatgttgtttatagaaagtaagaaagcaggtcttcttttgtaagattccatattaatcttaacccccgtaacattatactgatatatttttcaagttgattataactctctactacaaggtcaaaataaaccttatattaataaaaaccatatgacttgtctttagacatccaagaaaatttaaaagtaatactttgcgtgtatataagaactttcataatagacagtctcaaaacacttcagaaataaaatacactcatattatagcctggatgtctataggcattcactgggctaatgtttccttccaggactctgtgaccttctagaattactcaaagacagtgtgtttgccctcactggttgattttgtccttcaaagaaaattatttggaagaaaaaattttcaacttattagagaaaaatactcatttctcattttcttatcatttgacaggaagcttaccaatttattgtagataattacaccaatgtttcattccttagaatcacctttcaacatgaattcaaatgtatacgaaaagcaatagagaattctggactttagatttgcaagaaataaaaaggctccaattttcttaagttgttatgattaccacagagtaaaaaatgccatagaatgaaaatgtcttatgttgataggaagaggtcagggctcttactcgaagtacaagataaatcacaggcttaattttggatcacagtggacccctccctccacttcagctgtggaaatacaaagaaaagagttgcattgaagaaacaactggagtccaagtagcactttgcttccgttacaggacttggagcatgttataaatggctcaaaaagtaggatactctctccccttttcagggatctgtataaggaggcagtcatattcaaaatacaaagtagaagataaatgttttctgccggcatgatattttaaaaggaaaaatatgattatctaccatgatgcattgtgaactgatattattgatttttcctcttgtgaccttggttgcacagcaccaacacaaacacacaccccttgctggaaggtctagtttcaggtgtgaatgcgtagaagtcagagatttaaaaaatagggggcttgtagtatttgtttttgccttaattaagagttaatacttggcttatctacttactcattcagacagcgtgggttgaaaatgtattataaggcaggtaatgtgaggcaatgggggtgtctttaagaaggtaatagcttatctgagccttttatcctgcaggattcactatgaccttgcttttccactcccctcccgctgggtctttcagtctgtccccctttatttttgcttactcattcatgagtattcattaaactcctacaatgtaccaggcactcagaatatagctgtgagcaagacggttatgcttcctactctcatttagcttataattgagttggaagacagacattaagtaaatacttatattaataattttattgtaattatgatttctgttcagagacccaacataatttcaagtttccattttttcttaaaaaattctttctgattctaaaactttatagacaactaagaaaaaaataggaataaatcaggaaaaagtaacctaagatatcccaccagcccaaaataacttgttactatttaaaatgctttttcttgcacttttctttagtgtgtatatgtgtgtgtctgtgtgtgtgcacctgtgcccatgtgtatttagaatttgggatcatactatatagttagttttgctattctctttaaatgatcattaaacagagaggatttcttatattacatatttttcaataacatattttaagcttgttgaataatttgtattttagttatgtagcataaattatttgtttatttgggtacatttcagttatgtccttcaatttttgtgcttatttaaactgatgtgataaaaatataaactcttggctacatgttttatttagtctactagataatctagaattggaattacttggtcaaagggtataaatatttttgaggtgattcatatattttatgaaacattatagaatatttatactctttgatctattcaatgtaatatacaatatgaaacattcccctgtattctagaatcgcatcgatttatacatgccttcaagtggtatttgtgtcgagtttacgtatccttggcaccatcgagtattgcactggcaaatacatttctattttaattatatattaatatgatagataaaggtagcatcttggtaatttaatattttcatttatatatcatccagtagtatttcacgtgtgtacctgtaatatttgccagttttctgttgagatgatagccttttttacaaaataaatgaacatattttagacatataataaaattttagatgccatattatatattaatatgacttaatatcttatgtaatagtgtagacatatttcttaacgatattaataatttttgtttttttacaaataaaatgttgtatactcatttataatgctactttgagactgtgtggttatataaacaccaaatttttttcttcattatctctgttcttttgtaaacctgtttttcttttactaatttccctttttgcataaaaatgtcgtaatattcattattccaaatccctctcgttatttggtttgtattgtttcatagtgttacttcctcattctttggaccagtttcaaaatcacaatggacagttcaaaaaacatgttaaggattttgattcgaattacattaaaagtataaatcggtttgaggagaactgacatctttacaacattgccccatttcctccagaagtattatctgtccgtcagctgatccatgcttttctttgtatcttcctgtgacctttgatatgtttttttcatagatgccatgttttttgtgtggctagatattttatatttttgttgctattatgaatagtttctttttattgtttttttctggctataattgttatctttctctcttggagatcatcatcaactaagtgcaagatagtgacaggaggtctagtttcacatccctggagtatctgggaatctattgttatagcctctagattctggcactggcctataatttttaccagcctaatctctgctatcccctagctatgtatactgaagctgcagtgaacacctggtccccgcagccatctcattttctccttcctgcacatttgtctctgccttgaccctgacctctgccccaggactgtgtccatgctctgacactcagctgcatgctgccttgctccctcactcgtcccacctgcatgtgactgactcttcctccagacctttgtggcattttgtttgtatctttcttgggagtatttgtcatagttcaccttttatgatttatgattatacctgtcttgcccaaaagtgtgcccgattggaaggcaaattgtaaaagactaagcactgtgacaatgggaaagtaatttagattgctctttgcctcagtctccaaactcgtataggaatactaagttgtgccctgcccactgcataagacttcgtgaaagctctttgagatgtgagaaaggcgaatctaagagatggccaccgggaggtcacttcccctcctaggttgggcagtgcatgaaggcaaggcctggctttcacagtacttcatgcaggtttcatttagctcaacaccctcctctcatagacactcacagttagattgaatcagagggtggccacgcttggcaagcggggaatagcagccaagttgtagtggacttggccgtgtacagagaaggatggattccaggtagtgaaattagaaattacacctcagtcggggacctctggttacctctggcacttacattggtctggaaagaatgtatttatgttggtggggggggaaaagcatatgaaattgagacagtaggtgatccagtggatgttctaagacattccctggaaaacaatgccactgtcttggtgtgtctgatgttctggggaacatttgaaaaacatccgtctctgggccacatctcgagtttctgattccatagtttgagcccaggaacctacgtttttacaaacatccctggtaattcctatcgtaagtttgtgaaccattgcactagaacaggattcttaatagtgacatgcaggccttactgaaaatgatttgttctgtggaatgagaagctaacaaacacacgtacaaacacacaagcacatttcctagaataggcatttctgttctgtagaatttcttcaagtgtcttcttattgatctaccaaacatgaaaatatttccaggatagaaatgctttcccagaaagcaggtataaaggtgtttcattgggaaacatattagagactctacatattagagactaacagttgttatgatgtgaattttttctgtattactacataagtcactctttcttaattgctaaaaatatttatcagtacctgatcacagaattcttacaagacagcatggtctacttacactaggcgcctcacacagcaaattaaataagtatttccgtctaagaatttgcatcctaaacacttgcaggaggataggaaatggattctgtcattataataggatttaattattcctttccatgattttaaatattatgccaaatagatgctcatcgtagtatacaagtgctgaagaatatgagtagattaaaatcactcataatcctgttttctataggcacccataagcattttctcatgtcttctctttctcttacatatgttttttgttatggagttcctacttgataagctgctttgtaaagattttaaaattcagattatatcataggtgttttcatttatcaaaaacttcgttaaatgtccttttaatgggtgcataatagtttattatattggaggtaccatactttgatatgaatatccttgcagtcagaactataaaacatggagaattacattgttagtgcattaagcatttcaactcaacacagttaattgagacatttatatcatgtgtacattttccttataacatgcacttattattccggtgacataaatcttcagaagtaaacagagaaggcaaccgctagacgtagcctgtatgtgcagtagagggcagaggaagaccagcagtgtaatcacctggaagtcatcacccaaattaccttatttcattctgcagtgatgacacaatcaaagctaatgagcaattttacttttcacttatttcgggttttgcagcatttggagttgctgacgctcattggcttcctggcatcttcttttttgctttcctcccaccgttcttccctgtttcctccttcgttcctctcagcctcttctccgcgttccggttttcccacttgtcccttgttcttatgcaatacttgatcctcttctcactctaaactgtctcctggctgatttcctcttgctcccatgtctttaacttcctcctagagatgatgtcctgccaacttaaatcttattgccactctctccactgtgagactcccctaagctcccaccactcactgtggtccttgttcagatccatgctccactgtgtgatcttggtcatcctccactccttggatcccccaatcacgtgatctctgcttgtacacattgcaccgtatatgtttgctgtgccctgacgtccaagggacacgttgcatatgtggagagcagtggcaaggaatgattgattgcttgattgaccagtaactgattggatcactaactgataggcatgaaaactcctccctcactaattcctatataatcctcatctgagcccaggatttggtgatggtgctctgtaatatgtagtccaactttctctttctcacagagcttacatttctctgtgtttgtgtgtgtgtgtgtgtgtgtgtgtgtgttgttacctacatttaaggttactcaaaaagcagcaataattgtatcttatgtaattattgtctaaatttctaatcctttggtgccgatttctgaaacaatgttaacaaaagtaatcaaaggatgaaataatatatatttaattatttttgagttgtgtcagttcttatattaaatagtgtattgaatttagggactaaaatgtaattataacaaagcaattcactctaagaacatttgattgtttataatactgtagggtgtctaacagtagataggagacctctgatatttaccatagaagttcctttaaaaaaaaaaactcataagtaatacggtttatggaaaaattcatcttgtttatggaatggtagtgcgaaatagaacttgtattttagaaatgctttaaagatcttgaatgagatatactctctcaggttcttaaacataagaatcagaatatgaaaggcatgttttattttctagattttccttctctcgccatttgactaattcttacagtaaaagtaggggaagtgaatgaagtgaacatcaatgatcccatgctaggtttgtttatcttacttttggaaaacaatgataatgattctgtgtagggctgtggtttttaaattgcttgtctgctaattataagaaaagccaagatattgaaatttgtgtagtgctaattactcatccctttctttcccgctgcaatttacagtgtgtcttcagggtgtcagtcactgatttggagcttctgcctctgcttcttctcagcaattaggtctcatcttcaactaatggaattgagtgacgtttagctagtaatatggggaatctgtcttcagctctgcttcattagaagttggtgcgaggccttgaaaaaggtttcctgtttgttgctaagacaatgtgatttgaacttactctaatacccctttttttgagtcatttttgtctcactgtcttcttactgcttgccccacatgattctttgaccatcttcatccccaaatctgaattttgccttaagcaagatgtgcaaaaagtacttggttttacttctaaagctgatgtggtttataacttactcatttcctctccccacttcactcctacagtaggttttgctgcttttattgttgtcaccagtatttctatgtggtaatgatccttgaatcttattttgctgatcatcaatctgtggaagagaaagactgttaaaagaggcctcttaactcgcactttcagaaagatggaattagatggacttttccctttttgtcctgagtacagctaaaaactgtgaacattatatgaaaagcataggaagatactgaacagtggagagaagaaggcagacagactgaggaccttgagacctgatgaatggcacagtgctggcatctctgagctttccgtttctctcatttagcttgcactgggtgttgagaagctaacagtccagttgccagtgggcacagacaagaaaagcacccccaaaccctccccttcctcccaaaggaccacaaaggaggcagcttagaatgacagaaaacttttggacaataaccactctgctatagccaaatactaccgaagaaaactgtggccatattcacaaacccccaagcaaaggctgagcagggagcttagactttcagcgtgacccccatcagaatggtaagaaagaaggatgggtgtggggccaaggcttgtgtctcctcggtgtggtcacgcgttccctctcacggtattggagagagcacctgaggcgcctgaacttccaccttacctggtgctgtcagggtgtcccttgtcctccccactggggtgatatcagaagaggcctagtggagaatcaggattttcccatcttctcagtggtgacaagggccctcctcactcagagcgtcagtggaggcgtataaggagcagtcacagaaccctctgcacctctatctcagctcaggctgctatagtaaaacaccacaaatactggggcttagacagcggacgtctatttcctcacagttctggaggctaaaagttcaaggtcaaggtgctggccagctcatttcttggtgagggctttcttcctggcttgtaaacaaccaccttctcgctgtgtcctcacatggcaggtagagagagagaacaaactctctggtgtctcttcttataagggaaccagtttcatcataagtgccctgtgctcataacctcatctaaccctaattagttcccaaatgtcctatctctaaatgccatctcattagagtttaaggcttcaaaatacgaatcagttggggaggacacaaaggatcagtctataataacctcctacccaggagagacatcagcagagaggcccaggggacgctggagctttcacccaaacctgggaggaacaaggaatcaacttcccactcccaggtgtcaagagaggccaagtggggctcctggatgtccacctgccacctggcagaaatgaagggcggcacttctcttggattcctactagtgcagtgtcagaagaggcctgataaaatagaaggctaaagtaacatacacaatctcataacatgatatcccctaatgtccaggtttctagtgaaaatcattgatcataacaagaaccaagaatatctcaacttgaatgaggaaagacaagaaacacccacaacaagatgatacagatgttagagatgtccgaccagcattttaaagccagtcataaaaatgcaatcaatgaggaattacaaacatgctggaaatagaaagaaaaaagaggccatttcatcaaagcaatcgaaagtctcagcaaagaaatagaagagataatagagtactgaatggaaattttagaactagaaaatttaataaattcaattaatcttgatgatgtactcaacagcagaatggagaggacagggaaaagaatccgtgaacttgaagataaaaaaaatagaaaatacttgatctgaacaacagagaaaacagactaaacaaacaaacctcagagcctcagagatttctgggactacaataaaagatttcatgtttgtatagtcagtatccaagaagaagagaaagagggtagagttgaagaattattcaaagaaataatggttaaagatttcctgaatatggcattttaaaatatggcaaattcgttgaagaattgttcaaagaaataatggttaaagatttcctgaatatggcattttaaaacacataacctttcaagaagccgagagaatcccaagatcaaagaaatgcacatcaagaaacatagtagttaaacttctagaactaaggacaaagaaaaaaaattctaaatgcagccagagaaaacagtacctgacatatagggggaaacaatttgaatgtcatcagatgatctctcatcagaaattgtagtgaccacaagaaggtggcaaacatttttcacttactgaaagacaagaactgtcaactgctaattttaaagctggtgaaactatccttcaggaatgaaggggaaattcagacattctcaaatgaagggaaaactaaaggaatgtgtttctataatacctacccttaaagaacaggtaaaggaagcactccataaacgattttttatttttattaagatgagagttatcttgggacatcaagaaagaaaaaagaacagaaaaagcagaaatatagataaatagacttttcttttccttttgagttgtctaaattatgtttgttggttgatgtaaaaagtataacattgtcaaatgtagttcacagtgatatagaggagatgtttatgacagtcatacttggtgtaggataagggacttaaagaatggtaaggtttttatacttaaactggtaaacgttgatactaacacaccataagccttgtggatataatgcaataattaaagcaaccactaaaaagctatccagagagacacaaaaatgccataggtatgtcaaaatagaatttcaataaaatgttcaagtaacagaaaagcaaaaaagaaatcagggaaacaagaaaacagagaacacccacaacaaacaaacaaaaatggtgaacttaagccccagaatgcccataattatagtaagtgtaaatggtttaaatacaccaatgaaaatgtagagacaatagagaaaagtcgattcatctatacttttgcactttttgttctttcttctttccttccagatgaccccaaatacctcccaccttttttccccttatttctatttttttggtgtgcttccgtcagctattccttaaaggtgggtattataggaacccattctcttagtttttcttcactgataggagattggtagagtaaagaaaaaaaatgtggagagcggacatcttgtggctgtgtcgtgcgcgtgagccccatagggctggggaggaaccagttgccgcgcagggaggaggctgaggctatctacgtagaaaattccaaggaatctatttaaaaaaaactcagaataagttcagtaagatcaacatacaaaaatcaatcacatttctatacagtagcagtaagcgtggaaattgacagagaatacaatactgtttaaaattgctttaaaaaacacttaggtataaatccaacagaacatatacagcacttgatgttgaaaactacaaaataccgatgacagaaatcaaagtgctaaatttgtggccaacatgccgtgttcaacatgtccatgtctataaaaagtggactatgtgtctataaaaagtgaatttttcccaaattgatgtataggtttaatgtaattcatatcaaaatcgtagcaagactttgtgtaggtacagaaaagattgttctagttgggagtggtagcacgtgcctgtagtcccagctacttgggaccgtggggcaggtggattgcttgattccaggatttggggttgtagtgagctatgatcgtgctacagtgccctagcttgggtgatagagcgagaccctgtctcaaaaaaacccaaaaatataaaagattattctaaaatttatgtggttaagcaaaggagctggaataggtgaacagttttggaaaagacggataaggtacaaaggatcactctattcaatctgaattcttacaatataggtaatgtaataaaaactgtgatattgttgtagggatagacacatgaatcaatggaacagaatggggaacatagaaataggcccacataagtacagccaagagatttttgacaaaagcataaaagcaattcaatggaggaagaatagtcttttcaacaaatgctgctagagtggttggacgtgcataagcaaaaaaaaaaaaaaaaaaaaagaaaaaagaaaaattgtatcttgacctacaccctaatctttatataaaaatttacttaaagtgtgttggattaagtgtgaaatgtaaaactgttaaactttcagaagaataaacctctggggtttagaacttagtgaagtgttcttagacatgacaccagagacacagtccataaatgtaaaaattcaataagttggaattcattaaaatttaaaacatctgctctgcaaggggatgaaaagacaaaccatagactgtaataaactatttctaagctacatatttgagaaagtggccatatttggaatacataaagatttctcaaaattctacaattaaaaaaatctaatgctaaaatgggcaaaagacgagacattttactattgtacgttttcttgtgggagcaaagtaaatctttttaaaaagcaactgtgtctttttcaactcacttcttggaagtgatgatggaagtgtgtattcgtggctcctgcagaggttttagctggactttccatactggacatgaataagcacccctctccccctccacattagggccggatagcattcaccactctcacctgcttagtcttctgccccaaactgcttcattcatacctgcttctggaacattttctcgtacactgactccagcacagaggctgttctttctaagttctccctgaattagcagtgatgagatgcctcatgacccgagaaacctggccttggctgttccccatgttggactagtattggagatcacatagtttattgtttcacttgtcattgactagaaaataaattagaaagatggttcaagttcagcatttttactcatggtactccttgacttctgcctgttttgcaaaagagggtctgtagatgacaaaaacatgaaaaagacattcagtggaaatgcagattgaaaccaaaataagagatcactagctattagaacagctaaaataaaaagtagtgacagtaccaaatactcaggaagatgcaaagaaattggatgtttcatgcgttgctggtggagatataaattggtgcatctagaaaatattggaaaatagtagtttctttaaaaagtaaatgcgagactctgtctcaaaaaaaaaaaaaaaaaaaaatgtatgccgacgatacgacttagttctcctgaacgtttgtcccagagaaatgaaaacctgtgtctacacaaaatatgcttctggacattctagaagctttcattgtaatggccacaaattggaaataacccacgtatttttcaatgagtgaataattttacaaattatggtgcattcatgtcatagaacactactctgcatcataaaggagtgagccgttaataatgtaacacttgggtgaatgagtctgaggggaattacactgaaaaaaagcctgacttgaaaggtcacatgttgtatgattacatttatgtaacattctcaaaatgagaaaattatatagttgaactaactagtggatgccaggttgggatgaatgggaggattagatgtgtctattagagtagcaagagggaggtgtgtatggtgatggcagttttgtggctggactgtagtggtggtgaagtcagctacacatgtgataaagtgacagagctatactcacacattgcactaatttcaatttcctgatttttcaatgcattgtatttccttaagcagtatccattaagagaatcagggtaaagggcgcctgattttctctgttctatttttccaatttcctatgaatctataattatttcaaagtaaaatactgtttttttccttgaaaaaggagacttctccaatgtccttcaaaaatatctgtcgttggcttcccaagacgtgtgaatttgttgttgttttattgtgtttttgttttgtgtttgttggcatcaaccaatattttctttattttatttctgcacattttacttttgtttttcatctttttatttcaataacttttggagtacaaatggcttttggttacatggatgaattgtatggtggtgaagtctgagattttagtgtacccatcacctgagtattgtacattgcacccagtttgtcgttttttcttcctcccctttctgagttcccatagtccattatattgcactgtatgcctttgcgtatccacagctttgcttccacttataagtgagaacatatggtatttagttttctattcctgagttacttcacttggaataatggccttcagctccattcaagtttccgccaaagacgttattttgttcttttttttatggatgagtagtattctatggtgtatatataccattttttctttatctactcattgtttgatgccacattttctttatccacgcattgttcgatgggcacttaggatgaggatccatgccaatatcgattttttttttttttactttttaataatggccattcttgcaggagtaaggtggcatctcactgtagttttaatttgcatttccctgatgattagtgatgttaagtatgtctcttgtatatcttcttttgagaaatgtctatttatgtcctttgtccactgtttgatgatgatatttgtggttttcttactgattagtttgagttccttgtgttttctggatatcagtgctttgctggattcatagtttgcaaatactttcccccattctgtaggttgtctgtttactcttgatgattgtttcttttgctgtacagaagctttttagtttaattagatcccatttatttattttcatttttgttgcatttgcttttgaggtctcagtcatgaattcttttcctaggccaatgtccaaaagagtttatcctaggatatctaatagagttttatggtttcaggtcttagatttaagtctttcaccatcttgagttgatttttgaataaggtaagagacagggattcagtttcattcttctacatgtggctagccacttttctcaataccatttattaaatagagtatgctttccccaatttatgtttttgcgtgctttgtcaaagatcagttgattttaagtatttggctttatttctaggctctctactctgtttcattggtctatgtgtctacttttgtatcagtaccatgctgttttggtaactgtagttttgtagtataatttgaagtctggcaatgtgatgcttccagatttgttctttttgcttaggattgctttgggtcttagggctctgttttgtatccatatgaattttagtatttttttttctaattccgttaaaaatgatataggtattttgataggaattgcatgcaatctgtagattgttttggatagtatggtcattttcatgatactgattctttcaatccatgagcatgggatgtgtttccatttatttgtcatctatgatttttttcagcagtggtttgtagttctctgaagagatttttcacctgcttggttaagtatattcctagtgattttattttattttattttattttattttattttattttattttattttattttattttattttattttttattttatttttgcagcttttgtaaaagggattgagttcatgatttgagtctcagtttggtggttgttggcatgtagcaatgctactgattggtatacattgatttttgtgaactgaaactttactaaattcatttatcgaatcaagtagtcctttagaggagtctttagggttttctagttatgtgaccatggcattggcagacagcaataatttgactctctcttttccaatttgggtgccctttaattttttttttatcttgcctgattcctctggctaggacttccagtactgtgttgaatagaagtggtgaaagtggtcatccttgacctatttcagttctcagggagaatacttgcagctttgtgccattcatgatgcaactgtcatgatgttggatgtgggtttgccacagatggcttttattttgaggtaagtcccatctatgcctagtttgttgagggtttttataataaagggatgctagattttatcgaatgtcttttctgcatctattgaaatgattatatggtttttgtttttaattctttttatgtgatatatcacatttattgattcatgtatgttaaacctccctgcatttctggaatgaaacccacttgagcatggttattatattttgatgtgctgttggattcaattagttcatattttgttgaggatttttgcatctatattcatcaaggatattggtctgtagttttattttttgttgctgttatgtctttcctggcttggtaccagggtgatactggcttcacagatgagttagggaggattccctctttctcagtcttttggaatagtttcagtaggattggcaccaattctttgaatgtctagtagaattcagctgtaaatccatctggtcctgggcttttttgttggcatttttcttttttatggagtcttgctctgtcacccaggctggagtgcagtggcacgatctcagctcactacaagctccgcctcctgggttcacaccattctcctgcctcggcctcccaaatagctgggactacaggtgcccgccaccacacccggctaatttttttgtatttttagtagagatggggtttcaccatgttagccaggatggttgcgatctcctgacctcgtgatccacccactttggcctcccaaagtgctgggattataggcgtgagccactgtgctcggccagcaacttttttttaaattactcattcagtctcactgcttgttactggtctgtttagagtttctgtttcttcttgatttaatcaaggagggttatatgtttccaggaatttattcatttcctccagattttctaatttgtgtgcacaaaggtgttcatagtagtatcaaatgatcttttgtatttctgtgctgtcagttgtaatgtctctagttttattactaattgagtttatttgaatcttttcttctcttggttagtctagctaatggtctatcaactttgtcttttcaaagaacaagatttttgtttcattgatattttgtttttgttttttgtttcaattttatttcattttgctctggatctttgttatttattttcttctgctagctttgggtttagtttgttcttgtttctctagttccttgagatatgacattagattgtcaatttatgatctttcagaattttttgtggaggcactttatgctataaacttttctcttagcattgcttttgctgtatccaagaagttttgataacttgtgtcactgttatttatttcaaagaatttttaaatttccatcttgatttcattgtcaattcaaaaatcattccaggagcaggttgtttaatttacatgtgtttgtagttttcaaggttccttttgtagttcatttctcattttattctattctgatcagagaaaatacttgaagtgattttgatttttaaaacatttatcgagacttgttttgtaatccattatacggtctatcttggagactgttccatatgctgatgagaagaatgtgtatctgcagttcttgggtagaatgttctgtaaatatctgttaggtccatttgttctacaggagtttaagtccattgtttgttcgttgactttctctcttgattgtctgtctggtgctgtcagtggggagctgaaggccccccctattatcgtgtttctgtttatctcatctcttaggtctaatagtaaatgtttcatgaatctgtgagctctagtgttaaatgcatagaaacttaggattgtaattcttcttgttggattcatcctcttatcattacataatgaccttttgtgtctctttttttctttactgttgttgctttaaagtctgttttatgtgatataagaatagctacttctgctcacttttgatttctatttgcatggaatatctttttccatccccttaccttgagtttttatgaatcctcatgtattagtctcattgctataaagaaatacctgagactgagtaatttatttttttttaaaaagaggtttagatagctcatggtactgtaggttgtacaggaagcgtgatgctgctcagcttctggggaggcctcaggaaacttacagtcatggcagaaggcaaagaggagcaggcacatcttacatgacaggaacaggagcaagagagaatgagaggggagatgccacacactttaaaatgaccagatctcacgagaactcactcactatcacaaggacagtaccaggaggggtggcactaaaccattcatgagaaacccacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccatacctccaaggtccagttacctcccaccaggccctccattcaacattggaaattacagtttgaaacgagatttgggcaggggcacatatccaaactctattaccttacatgtcaagtgagtctcttgaagacatcagatatttggtttgtattttctatctattctgcccatgtgtatcttttaagtggagcatttaggccatttacattcagtgttaatatttaagtgaagcacttaggccatttacatttaatgttaatactgcattcatgatactcttccagccatcatgttaattgttgcctagatactttattttatttattgcattattgttttataggccctgtggctattatgctttcaagaagttctattatggtgcataacaaccttttgtttcagaattcagaactccttttagcatttcttgtagggctggcctggtagtgacaaattctctcagcatttatttgtctgaaaattactttatttctccttcaattatgaaacttagttctgctggatacaaaattcttggctgacagttattctgtttaaggagcctcaagataggaccccacatcctttgggcttgtaaggtttctcctgagaagtctgctgatagaagtcaggaatggtttccctccatccatgctggagactgggcatgcatgcaaggcccttccttctgctgctcctacttaatattccccacccctccctgtatcaggttcagcactaggtagggttaaggctttctctgtggactggattgccaggttccctggaggcagtccgtcccactgtcatactcacagttcttcacctggctcatggtgtaggctgcagcctgctgcttctttcaaagggtctgtggtttctttccatttttctgttaaattccttcattgtttcttggaagaaagttaatggtgtgtctctgcagactattttttctttccaagggggagacgcatgctaacactgcctccaatccaccatattgaaaaaaagaagttttcctatttttaaagtaaaatccttttcttgaaattgggcttttgaaacatttgcctaggtactttgcaagatgaaccaaacttctaatatcaaagggaacttggcccaccaaagggtagaagctgtaggctctctcctcctgctgtttgtcatcaaggcccacacaggggtcctggccccagctgcaagatgggctttgtgtgagctcacaggagcaaagcacgtgccaggtgccccgagacttaaatgttctctctgcttttatatcttttcatcatttcatagtttctgaaattatttgacatattacttgactataaaggaaaaaaaatcagagattttattaaaactctgtaaacattcctaattaaacctcacatgttgttcacaaaccttttatgttttaagctgcttcaggacagagaattgattctcctctcatttttcactgacagatctggtggtacttagagccagtaacatgcagcagttaattatgctgctgtcccacatgtgtacattttgttttcttgcctgtatttgttataaagagggttcatgttacattcctctgcaccctccagaatgattaggtgggcgtgagatcctcacatactgaacacacacttagtaactttcttgttgactggttattctgttgtttcatgttattttaatgagactgggaaaaaagccattgctcaaatctggttattctttattaaagttctcatattggaattattaaggactaatgtcattagggacatttctacttttgatatagaaacaagctgcttagggaaaaatctcctgttttcatgcttgacagtgtagtttctcgtagttaaaacaagtctttatgtactgttttatctcctgtgctaaaacagaacggtgaaatctaaggcaaacattgtgtgtgtgcttcgacactctcgtaaattactcttgccattaatttaaccacagttgtgttatcacttgacctaaaggggctcctggatgattgggaaaccagcagagaggctaatgggccaacaatcttggcagccaacctccgtgtatgtcttggaaaattccttcaggatgtttgctttggcatttgattgttcctatcttcagattaccttattttatagtatattgaatgttgcatcattaacaaatacctggttgatatctttattactgtggcttcaggcagtaatacaaagatttttctctaaaatacaaagtgtatttgaaagcttttctttacatgtatatcagtttcaaactttacaattaaattttattcccaggaaactctcaggatgttcttttgtgtattcataaggtataatttgatggcaacttatattatttttcagaaaggaaaatagtttcgtatccaaaagtttgaattgtcttatttaagaaagttgacacactttaatcacaggaaacagtatgatttgacttttctaaaccacataaaagtatttctaaatatttttgcagatctcttcttctctttaaagtgagaataatcttctttaattttggagactgtgctaaccattatctttgctattaaggattagttttgtaactaaatatgtgttgagtcctgggctcacacttcagggatacatcaggagacaagtaaggcctctgacctcgtaaaatttacctgggagagacaggtagttccaagtaaacaaatgaataaacaagatgatgatagatggctgtgaattctatgaaggaaacaatgactcaggtcatggaggtgatagtttgctttggtgggtgatcgggaaggctgctctagggaggtgacatttgcatagcttcctaagtataagaaggagccagagatgctgctggtaccagggctcagagcatttcaggccatggagttgacatgttcaaagagcccaaagcagaaaagctgtttggtcaagaaacaggaagaaaatgactgtggctgtagtatcataagccaggcaaagggtcaaggcagggtgggagagttaggcaggaaccagatcctgcaggccctggaggccattgaggttcttcccattctgagtacagtggggagcttctgtatgcctggaagctgggggcgttgtgatcttttgatttgactcctgggagaccagggaggagccctgccatggtagacttccaggggaaacatctctgtggctgttttcctgtgcgggcaagttactttgtctaaagcccagtttccacattagtgaacaagattaatgatggcatctacacagtagggttggtgtgacagttccataagaacatgcatgtgaaacggttaatccagtgcttggagaaaagcaaatgctctacagcagaggtccgcaacccttgggtaggaaccaggccagtccatggcctgttaggaaccaggctgcacagcaggaggcgcagggtgggcaagtgagcgaagtctcatctgtatttacagccattccccatcacttgcattcctgcctgagccccacctcctgtcagatcagtggcagcatatgattctcataggaccgtgaaccttattgtgaactgtgcgtgtgagggtcctaggttgcacgctacttatgagaatctaatgcctgatgatctgtcactgtctcccatcacccccagatgggactgtctagttgtaagaaaacaagttcagagcttccactgattctgcgttatggtgagttgtataacgatttcattatgtattacagtgtaataataatagaattaaagtacacaataaatgtaatgcacttgaatcattccaaaaccatcccccaaccctctggtctgtggataaattgtttttcatgaaactggtccctggtgccaagaaggttggggactgctgctctacagcattataacgatattgtcatgttgttttaaagatggataggacatttcactgccttcctgaagcgcatggcagtgggcatatgaacagacatttactgggcagtagttaccttgttagagaaatgggtacaagagtatacctgttcacctaggaaagaagttcattctgaggaaagggtcagaaaagtcttcctaaaggagcagagtctaaatgtggctaaataaacaaggaatggccctgcgacttggcccaggtgcccccacaatatagaccccttggaccttcagtggtgccattggattctctcctttggttagtgcactgttccctgaaagcttctgtgagctgcaaacccatatgcctgacacccaggaatgctgattgctgttggccacaagcttgtcttaaggggatgggcaccaaggcgtgcccatgtggctggggcatggcagggtgccaggaggcaggtgctgcgtccctggagaagcagatcttgcacagcggggagcaggctgaaggcaccaggaaccctctgccagcacacccctgagataagcacttccttcaaagctgagtccggctgctcagcgaattgatggatgatgaagacattgtcttcctttgttaggataagaaggataatgatctttctccttccaagtcgtctgggagctcaggctctgtgttgtgataaagtacaattggggttgtttgtctttccatgcttacagaaatcctattcctcaagaaaagaaagaaagagcctacaaagaacttaaaactaagtaaggacttcaaaaaagaaaggtggagagaggggaaaagatgactgctacacattttccctttgcttcccacgggaatggcttcattcttgccttgagtgtcttagatatgtctctcccccacccgcagcactggcttttctgtcttttaccattgaattaggcctggtctagacttcagtatttatacctgagagtacagaaaagaggcttttcaagaatacgtcagttctgttagaataagatcccatccgtcatcagatacctttctacagctttctgtcacagtatttgatcactgatcatagaacctggactagagatttcatgtggagaatgtactcccttcaaaaggaaaaccattcaacaatttaatatttaattgattaaatacatgtgatttgctaatgttaaggtattatagtcacagcccctcacttgttgacaagtcctatatcaagtaatcatagtgattaaaaacaaaaccgagagtcaggaatcagcaaatcaggctttccactgccaaaatgaacattatattaattcatgactttatttaaaagagagagcacctcagaccctaattcaaagactgtttcatctcagcccacaaacatcgaaatatcagatgagaaacattttgagaggcaggtgtgcagacggcagcaagtcgtgagccggctgcctgacagcaaaggaggaagcgtttaaagtatggagccaggaattcaaaacaacaacacgttgacgccatggtgcacatccagggcaacagaaagagctctggacttagactcagagggacgggaaaaactcagaggctgcagatagaccaggaggtagaggccttgatcactccttgtgtagccagacccgttgcttaaaatctctgaacttccttattgtaaaatatgaaggaaaatcattactattcttagaattaaatatttgtgaaaggagctttagaatgatagaagtaccatagggatgttattatcttttttactctcttttcaacctgtcaattacctgtttaaatatgaactagttattcgcccttccagagtctcagtttcctcttaaattaagaataataagtttatcccatttgctcatttcacatcagtcctttaagtgctttgcattttgttacatcttatgtaagtggtgatattagcattactacattgtaacacagtacacaacatctgaaaatggtcctgaggccttcaaagtttaaatgtcgtttaatacactttattgaagcaggtacagaactgctgtgtaattaatttcaagacacttattttctctcaaaagtgcttctaaaacaagtttccatgcttgaagcgttgagtgtcaagtatctgggagatttgcttttgtaggacggttcatttcccacttgtgccagaatgagtcattttgtgtgtaagtgtcaagcttggagaggttctaattaagtgcaaattacaatgaaattaataaatgacaccaatttttagattttaaaatgtgctttgagagaatgcaatgtgggcttagattgatggtaattctcatattttaagttgtgattcaatattatgtagcattaaaactcaattaagtaaaaaataaatgaagaatcaagtagagagaatactcatctctcagatgcctcagcttctccaatgatggcttaaaatctgttaaatgctaaggttgtaattgtccttattgttcactatattccaaaataattgcacatataattagcttatttagtgagagatactaaatcaccctgttcacaaatatactagatcgtcataaattgtacaaatgtaattgtaaatttaaggttttattttactttttgcagatgagctgcagactatatataaattcatgtatgtatccacttaccagaaattttattaaatcaaaatatatttgacccagcattttccgatccgtttacagtgggagaaggtaggctacgtaggttcttccctcctcaggtggcactagtcaagactgacagagccaccagcaactgatagcccaaagatatcctctcagcctaccgaaccagacacccctcaccttctacctggtgatgcagggaagcccagggaagtgcgttctgtcccacaggaggcaatagcagggatagagaaggatccccagaccctacagaacaaaggagaccaggacagctctgaaaaacacattatcattggaactacagcccaaaaaagtaggcaaagtcctataccctaaacccatcaggcaactgccatctaaaataaaagatttaaataggacaaggagtcttaacataatatcgaaaacgtccacagagaatggaaaattactgaacatacaaagaacaaggaaaaatcacaacttgaatgagaagacacaatcaactgaggccaaaattgaagtgagtcagctgttgcaattaccagacaaggattttaaagcagccatcataaaagggcgtcagcagcaaactattcattctccttgaacaaatgaagaaatagaaaaatctcagcaaagaagaagaaattatttaaaaagtgaaagtgagtgaattgaaacattccataaccagaattaaaaactagcaggattagctcagtaataaagtggagaagacaaagatagatcggtgaatatgaggatagatcaatagaatttgctcagtctgaccaacaatgaaaaaggtagacaaaaaaaaaaaaaaaatgaacagaggctcctgtgaggctgtaaccaaagatctaactttaattttattggagttctagtaggagatgagaaagaaaattgggactgaaaaagcattcaaagaaataataggtgaaagctttctaaattgggggaaaaaaaaaactccacaagcctacagattcaagaagctgaatgaatcacaatagaccctaagaaatcaatttgaagacacttaaacttctgtgttgaaaataagtaatttctgaaagctaaggaaaaattagaactctgaaaaaaatctgtcaaccatgaattctgtatttggcaaaaatatcattcaagtatgaggggaggccacgtgttatcacgtgtaatatcagacctgtaatcccaccactttgagggacattgatgagggaggattgcttgaggccaggaatttgaggccagcctgggcaaggtagtgagaccccattgctacaaacaaatcaaaaaattagccaggcgtggtgcacacccctgtagtcccagctactcaggaggctgaggtggagaactgcttgagcccaggaggtcagtgctgcagtgagctattacggcgccattgcacttcagcctgggtgacaaagtgagaccctgtctcaccaaaaaaaaagaaaaaaaaaaaagaaaaaggaaaaatcaaactaaggaaaaatcagataatgtgttgctataatagttaaatgaggtcctccaaacagaaagaagaaaatgatcagagaagaaggcttgcaactacagaaaagaaagaagaacaaataagtggataataggggtaaataaaatacactacttttcacttcatgagtttcctaaattatatttgaagtttgaagaaaaaaaatttaattccatctcaagcagtgttaaatgtatgtagcagaaatacttaagactattagattttaaaagtggggaagggaaaaagatttcagtccttcctttgaaggagtggaatgaggatacaagtaggctgtgataggttatagatgcctcttataacaattagaggaactaattgaccgaaatagaccatatcctggttcataaaatctcaatgaattttaaagaatagaaatgcatagtatgttctgtaaaaataaaggaatcaaactagaaattaacagagagataacaggaaaactttaaacatgtggatattaaacaacttctaaataatccatgtgtcaaagaaagtatcttaaagggaataaaggaaacactgaactgaatgaaaaatcaaaatgcaaaacaccataatttggcagatgcaactaagggcatgctgagaggaaaatttatagcattaaatgtgtatattagaaagagggaagtctcaaatcaataatttaagctcccacctaagaacctagaaaaagcagataataagagaaaagacacaaatcactaatgttgtaaatgaaatgacctatcactatggttactgtagcctttaaaagaatgataggaaaatactacagcaggtttatgcccataaagttgaaaacttagattagctggaccaaatgctcaaaaactacaaagtgccaaaaactcaacctatagatatataacctgaatagtcttaaagcccttagagaaacttaatttgcagttaaaccctccccacttgatatcctggcagagatcatttgacttgagaaatttgccacacatttaaagaagaatttaaatcagttttacagggttttgtttattaaattaagagtaggaaacacttcccaattcatgttgtgaggccagtattattctgatacctggaacagccaaagacagcatttaaaaaaaaaaaaaactgtaaacctttatgtctcatgaatataggtgcaaaaattctcaacacagtaatggcaaactgaatccagcaaagtacaggaagaattagacaccgtaaccaagtgggtgttattccaggcatgcaaggctggcttcatatttgaaaatcaactcatgtaagtcatactaacagcagtccagagaagaaactttatgagcatatccattgacacagaaaaagcgtttgataaaatccaacactcagctggttgcggtggctcatccctgtgatcccagcactttcaaaggccgagatgggtggaatcacttgggctcagaagttggagaccagcctgggtgacatggtgaaaccctgtctcaaaaaaataataaaaataataaattggccagctgtggtgccaggtgcctgtagttccagatacatggtgggcctaaggtgggaggatcgcttgagccccggaggttgaggcccggaggttgaggctgcagtgagccatgtttgcaccactgcactccagcctgggtgacaaagcaaaactgtatctcaataaataaataaataaataaataaataaataaataaataaataaataaataaataaataaataaatatctaacactcattcatgctaaaaattctcagcaatctagttatagggagtagcttcatcaacttcgtaaagagtatgtacagaaacttacaactaatacacttagtggtgagaaggtgaatgctttttccccaaagttgggaaccaggcaagaatgaccgctctcccactcttaacagagtacctaaccagtacaataaggtaggaaaaaaaaaggcatccaagtttgaaaggaggaataaaagtgttcttatttgtggatgacattattgtcttcattgaaaatccaaaggaatttacaaaaaagtcccaagctaataagtgattccagcaagcttgcagtatacaaaatcaacacataaaaatccatcacgtttctatataataacgcgtggaaaccaaattaaaaatacaataatacaatgccatttataattgttccttgcttttcatcctaatgcctaagtcctgggaacaaatcttgtttgtagatatacccaaatctatattataggtatacccaagtctgtatttcatttggggataaatctaacaagaatagaaactattttgaaatttacaaaatgctgagaaatggaagaaatcaaagacctaaaaaatcagagagactttggggatcagaaaacccagaaaggttttttttttttttttttaaatataggtactagacctagacagtctcattctgaaatgtagatggcatagcacaggacctataataactaaaacaactctgaaaaagaagaaaaaagtaggaggaatcattgtttccagtgttaacgcttactgtatcctgacagtaatcgtgactgtgtggtactggcaaaggaaaagagacataggtcagtaggacaagacagagaacccagaaacagacccacacgaatatgcccaactaatttttgacaaaggtgcagaagtgactcagtgaagaaaaggtggcctttacaataattgtagctggagcacttggacatttaggacaaaagtgggtggaaccttgacctaaagttcatatttcattaaaaagaaaactcaaaaaagtatcacataaaataaaaactgtaaaactttaaaacttttaggagtccgggtgtggtggctcacgcctgtaatcccagcagtctgggaggctgaggtgggtggatcatgaggtgaagagattgagaccatcctggccaacatggtgaaaccccgtctctactaaaactacaaaaattagctgggtgtggtggtgcgtgcctgaagtccaagctactcaggagactgaggcaagagaattgcttgaacccgggaggcggaagttgcagtgagccgagatcgtgccactgcaccccagtctggtgacagaacaagactccatctcttaaaaaaaaaaaaagaaagaaaaggaaaactcagagtatctttgggatctaagactaagagaagagtttttaaatttgatgataccaaaggtacgatttacaaaaataaaatcttatcacaattaaaaacttttatgaatgaccttattaagagtataaaaaccagccactcgggaggctgagggaggggaattgcttgaaccagagaggtggaggttgcattgaggcaagattgtgccattgcactccagcctgggcgacagagcgagactctgtgtcaaaaaacaacaacaaaaaaagtataaaaacaaaaactgcagacatggaaaaaaaatttgtaaaccacgtacctgatgaagaactagaatatactagaatatattgaatatatagactactcttagaactcaacattaaaaacctatcagaaaatgtgcaaaatacatacacagatatttcaccaaagaggatatacaaatggcaaacaaacatgtataaagatattcaactttactagccaccaggaaaatataaactgaaaccacaaggagatatcactacaaacccatcagaatggataaaataaaaaagttgatagcaccagataatggcgtgagaatgcagagaaactggatcactcatatattgttagtgggaatgtaacctggtacagccactctagaaaatagggagttgagaatttcttcccaacttactctgtgacccatgggtgcttactttatgatcctttgcaagctactgcattcttgggcatatctcagagaatgaaaactacgttcacacaaaaacctgtacatgagtgtttctagcaccattgtttgtaatagcccaaacctaggaaaagttcaaatatcttgcaatagacaaatatttaaaacacagtgtagtacttccattccatcacacatcgctcataataagaagtgatgggcttctgatacacacaactgggatagacctcaagagagttatattgagtgagaaaagccaatctcaaatggtcacagaccgcatgagtccatttagattccatttatttaagatccctcaagttacacagttacagcaatggagaagagatcttttgttgccaggagttaggctttgggatggagagcaagggcatgggtggggcttaaaaagggagctggagggagcttggaggtgatggaactgttccctctcttggttgtggtggtagttacataaagctacgcgtgtgataaaattgcatagagtgtatttacacccatccatgagtgcaggcactgctggtgtcatctgaatactctctatgaattctcccaacatcagtttcctggttttgatgttgtttggtaaactgtagttactcagcacgatgttggcactggggcaggttgggtgaaggatgaatgggtttcactgtacatttctttgaactcctcgtaaatctaattatttcaaaataaaatgaattaaagacaatatgaatgagagaacatcaaataataaggctttcacagtacagcgtaggcttctaaagtttgggaggagggccttgagatgatttggtaacacctctgtgggtgcacccttctgacgcaaatgaccctctgttgtctcttctgctctaaccaggcatcagctatgtgggtgtctggtgtttccaaaggagggtaggatgagatcagagagtgcattgtgtgctcactgaggaagggggaggaataatgatctgttcccaggattaagaaagaggaagaggagatacaggaccataagaaaagagaacccagagctgagagcttgtaggaatgtctctgctccattctactagggcttagaccggttggcataacaacttcatgaactgtcggccatccttaagctctcctttaggtaccaattatctcctgattttctcttcattattaacagtaaattattttcctttcctctttcctttcctttcctttctgacaaagtctgtctttatcacccagtctggaaggcagtggcaacgatcatgcctcactgcagccttgacctcttgttttttttgtttttttgaggttatttttgtagagccagggtttcaccatgttacccaggctggtcttgaactcctgagctctagtgatcttccttccttggactcccaaagtgctggaattacagatgtgagccaccaggccagcccaggttagcagtaaatcttgctaagattggcccataaagaataccctggcttggtagactgtacagaagaaggggagactcggagaccacgtcctatgccatagccactattagagagacaggagccccaagaacagtcgaagaggagtggagtttaggaaacaatcagaacaatctctctcccctggtatggcagccgcaaggaaggggcaccctggggagtcagcccagggtagagaagtacatttggagcctttaatcagggaagcttgcagggctgcggcactcaccgcaggggacaccaccagggggaaagcaggcaggagccatttgccttccctcctcttcaatcctgtatctatgtccctgtgctgctgaggtccaggagctccttagggatgcactgtgtgtacgcgccttagcacgctgcacaattccggacacacggggtgcttataaagcgctgtggtgtatttagcagcatcctgtagccaccacatggtgcccagacagctgcaggctgaactcaagtgccccaccccctggtgcagaatcctcagatccggggactcgcgcgggtggctcagcaccgccctctgtctgttcttaggtcttgctcagaggctgaagcagggtgggctttctggctcacagggccatctgaccactcccctcctggccattccccctcctctctcaggacatatgctttccccaagatggagaggagagccagcctgaatccttggtgtttgtaaactcctttcacctggaaattgctttacatgttttaaacttcacattactctttgggagaagaaaagaagtaacaagtaatattcaatttcacacttgggaaacaaacagtgaagttaagtaactttcataatgccagatagcatatctgtgttaggaaagaatgtgtgagtccatataaaattctgtcctcagacgtttctcaagtgtgttctaaaataaaaggcttctgtactcaaaattgagctttgtccctgttgaatagtaaattaagagttcaaaatgagacagtaaataagttagaccaagtaagtaagctgcctttgagtatggaggtagagacataaattcgtatgattaccatagaaaacaggcagcactttcctgaaagaagagcaatttttatatcttaaatataagcctttgaaaaatacggtatttgttgataaaaggaaacttctaagggctgctactatatcttgatgacttaataaggggatctccctgtggatggggtaagttaaaagagattatttcttcagtttttctttattcacacactagtagcaaaattagaaacatcagtgagaaaattatatctgatttgttgatataaccttatgaactttccattataaaacctgaaattaaagtatatgttgttttctttaatgaagtttaaagaattggaagaagacatttcattcagttagtaagtaaaagttgtgtgtgtgtgtgtgtgtgtatacgtgtatatacacgtacatatacatatacacgtgtatatacacgtacatatacatatacacgtgtatatacacgtacatatacatatacacgtgtatatacacgtacttatacatatacacgtgtatatacacgtacatatacatatacacgtgtatatacacgtacatatacatatacacgtgtatatacacgtacatatatatatacacgtgtatatacacgtacatatatatatacacgtatatatatatatatatatagagagagagagagagagagagagagagagagagaaagagagagagagtctcacctgttgcctaggctggagtacagtggtgtgatctcggctcactgcaacctccgcctcccgggttcaagcgattctcctgccttagcctcccaagtagctgggattacaggcgtgtgccaccatgctcagctaatttgttgtatttttagtagagacagggtttcatcatgttggccaggctggtctcgaactcctgacctcaggtgatccacccaccttggcctcccaaattgctgggattacaggtatgaaccactgcgcccagccaaaaattgctgtatgaaatagttatcagtcaggagcaggagctcacacctgtaatcccagcactttgggagactgaggcaggaggattgcttgagcccaggagtttgagaccagcctgggcaacatagtgagaccctgtctgtacaaaacataaataaaataaaataaatagttgttattctattgtaccatcaccttattatgtctgagcagtatttgtttgatgtaggctaaaaggtgagaagagagaaacagaaaactgtgatcatgattatgccttccaaggggcctaatattgaactgtactaggtcgactattaacagactaaaaatgtttgaaagcgcatatgcaacaaaagtggtttttatcccaagaaaagccctggataggctgcctggtccttgggttgctgtcttccatgaggtgattcagagacacgggctgcttgggtcctgcagttgtactgtctaccagctcgcctgcagtcagctttcggaaggaaaaaggaatgaggagggagcccacctacctcttacaaccctggactggcctggcccagaagcatcccatgtcatttccaccacccttccaccgaagagaacttgtcacatggccatgtggccatgcctacctggaaagagggttggaaatacaattcctggctggggtttaaatgtgtattttagaaatgaaaatagattttcgtggacagccagctcagctgcctcagaggccttcttaagctgcattagcttagactttcttatttagccacatcctgattcaatgtgaatgggcctagttgttacttttaagagaaagatagatctacagagctgaatcctttttcagtagatagaggaagtaactttctgaatagagttcagttaagaaggaattgctagggactttcttgctagaagaaaatctgccctcatttgtactagagaggtaaaagaatgcagggttcaaggaagacggactttcacatggtactcccagcaatttcatgagatccaaagcacatggatctcaggactttgagtgaggaaggaactgtccttctcaaagcattgcagcctgataagggctgaaaaggaggagggacttggcagaggacctgttaagtaatcctctggctgttcgccttgcaatcagaacattgtgtaggtttgataaatttcatgtttttcaaaaaaattctctattcatagttacacaagaaactgtgatgagatccccttaagagaatattaatgctatcaatacagttactattattccagcacctttagctcactcttgccactctttggcgctctactttttaatataaaccatacatagagagacaggagccccaagaacagggaggctggccaagctggaaaaataatcaaagcattctctgtccctggagccccagccgtaagtggacaaacttcagttgccggaagccaagaccactggagagaagaaaattgctagtaccagtgtgggagttgtactgtcgtcttctcttttataagcatggtcacgaatgacatgtgatttgaaaccacaatttactaccgtaataaagtttctaaaattactgcagtcggactccaatcgtattgaacagtcaattgattctgggttaaaacatgcttacatcacaaaataatgaccggtttgagaaaaataaggttgtcttcaggagccaatatctcagtgcaagacggacactattaaaattctttaggggaaaataaattgctgatttgctaagtgtgcttgaagcaatatcaccttacatctgcctaatgttctttcctcacagcctcccagtgaaataggtaaagcaggaatttcgactttatagagaaggatctagggatatgagaatccatcatgtgagaacattttagataagtagcggaacccaattcataaaactctttacactgctccaagtaaaacagggcagccagtggattgacacacactgtttttaaagaccagatttagaggtatgctcactcaaatctgttaattctgatcagtgtgaagaacgaagttagtgcttttggatattaagatagttggtataggcaaacaatgaaatttaaaagcagtcactcgactgtaagtatttctttcttacaggaaactgtttttgcagtcttatggcaaattttgaggcccaactctcacccttttgcatgttttcctgtaggaagtaaatgaattctttgttttgtattttgttagcactttctaaagtatttgttttcatttggttttatccattgcaaggcaattgttactgattttattctttgtcgttgaatcatctccaaggttataagttatgttaaaaaacaacttagcctttaatgcttcaaaaactttaaaaggtgggtagtgggaacatcaaccactgtgttctctcatataatcgggagctgggagaaatcacagcagattttgacagtgtcctcagtaccagcagaccttcctgcagaagggtgtccaaacttcctgggctttattcctctattaaatgttctaccaactcccccaactcttctctttactcaacccttgacatgaaacacctttctactgtgtagtccattagggtgtaaatcacaccaaagaatttttgctcaaccactttgctagatagattggaaagaaacaccatttattgcatactaatcaaactgtaattgcctgtcttcctgataaattgaccatgaataaggtaggtctctttgactgacagtcttgggaatgtgcattgcagtctttataggcatgacatgcttctgataagaaagcaggcttgctgtgaggaaggaaacaatgtttccctcttttgaagggactgattttcacaattttcacttgcatcataaataggtgttggcaaaagtatcactcactgattatgtacatggcagatagagaagcatgttacttttagtttaaaaaacaaccttgttgccatgttgatttaatcagagttctgtttgtttgtgtcttctcatctaatgtgtaatcagaaccccttaataggaagtggtttcattccattgctctgtattctggagagaaagtctgatgttggatttatcattaacgtttgccatcagcttgtcaccaccaaagccctctgaattattttctgtgctctctataaggctggttctgctctgccatcctctttttgccagggagagaattttctttttttttgagacggagcctcgctctgtcactcaggctggagtgcagtggcgccatcttggctcatggcaacctccacctcctgggttcaagcaattctccagcctcagcctcctgagtagctgggattataggcacacaccagcgcgtccggctaaattttgtatttttagtagagacggggtttcaccatgttggccgggctggtctcgaactcctgacctcgggtgatccacccgcctcagcctcccaaagtgctgggattgcagacatgagccaccgcgcccggccgagaaattttaaaatgagtcaccaggaataaaatatattaaccaagcgaggtccaccgtttattcagattttcctagtttttgctcaatgcctcctttctgttccaggatcccatccaggataccacattacatttagtcactgtatttccttaggtttttccagtctctggcagtttctccaactttgctcgttcttgatgatcttgacagtttgaaggggcactggttaggtattttgtaatatgttcttcagttggatgtttctgatgtttttctcatggttagactgatgatgagtttgaggaggaagacagcagaagtgaagtcccactctcataccatgtgaagggcccatgccatcagcatggcgtgtcactgttgatgctgaacttgatcaccgctgaggtagtacttatcagctatctccactgtaaagttactccgtttctctttgtttttgtactacttctacctattttaactctagctgtcctgcaagtgctgtctcagggttcactccttctgggtatcttctcttaaatctgaccaacttagtggaatgtttcaccacagacataatttcaaatagcccagttattgagaattgcattaggaaggaaggcgggatgtgctcaccacctcttagctgagtgactccctctgtgattccatcacatctcacaactgtagtcttttacacatgaataaatccccaaaactcttcccagcatttctttctggtcaacagtggagaaaggccttgtgacattgagaagagaagttggccatgtagtcatgagttagcaaattccagtggctgtttctttttttgagacagagtctcactctgtcggcctgactggattacagtggcacgatctcagcttactgtatcctccacctcctgggctcaagcagttctcctgcctcagcctcccaagtagctgggattacaggcatgtgccaccatgcctggctaatttttgtatttttagtagaggcggggtttcaccatgttggtcaggctggtctcaaactcctgacctcaggtaacccgcccactttggcctcccaaagtgctgtgggtccgtgagccaccgcactggaccaacagtggctatttctaagagacctatctctctaaaaaaaaaatctctagaaaaacttgtatttaaaaattatgaaggcaactcgagggagaatataggatgccaacggtgtctcctgaccttagcctttgcgattaggtgctgattgtgtgaaatccggcttgatcatttgctttaaccatactgggcaacattgtccttgcctggaggatgtttatatttattttaccatggcatcaaactttttaggatattaataaagtttggatgtaagatctaatgaaattaagtgttctttatcttaggaaaacatcattttgttttgcatttgcaggcggagttagcatttagatattcaggtttgggactatgaaggtctattctcattctggctaatatataattccttaacttaatggttctgttgttgaaagtgcttgctctagcgctgtattcctacacagtagcctagactattggtcgagggggaggatttatcccttaggaaacacttaacaatttctggagacatttgtggttgtcacaactgggtgggggccacatttgccatcttgtgagtgaaggccagggatgctggtaaacatcctgaaattcacaacctctcacagcaaagagttatctgacccacaatgccaacagtgctagatatgggaaggttaattggttggccacattacctttgcttcttgtctggggcagctttccctagaccctgaggcatgttgtatatatacttaattttgttagatcatcccagagaacatctgcggccctaggtcagcttcacaatgagtctaacttctagatcagtggtttccattgagcctgtgtgaacacgaagatcttttttaatgaccagaatttttagtcttataatttttgagctcttattatttaagaaccgagaaaatcctcggttctcggccttttggctaagatcaagtgaagaactgagaaaatgtgtgatgatgctaacatacatgctatctcgcatgcagtggctgtggatttagtaacatatctcgagtaattttcattttgttgaacataacatttggaaaacagtagtacatatatatgtatatatgtgtgtgagagacccattatttcattattcattctacagatagtacttgggtacacatggatttgatggcccctagcaggaaatatttgtcctcatagagaaaacagcccacagcttagggaccattgctgatgaggatccctttgaaacagagatgacttggagaacactcacatctgtagctgaaacaaacagtctaggaaatagggaagggcatctcagcctcacatacagtgcccacttattaaatttctgcaaatgatgggaggtgctctgttgtggttttcatgcctgttgttaaaggaatctgacagccgaggcatcaggctgctttcttcagccctggtgagagtaggagctctggagtgaagccagtgaatagaactttgccaagattctgaatcttctgggaccatctgtgtctactttttcaaaaagcagattgtgtgaaatgacaggtgggtaggacacagaaggtaatagagatgtgaatgagaagactctaggaagggagagagcaagtacgggtgccagcgggaagagcccagcagaagattgagtgtcctggcagcaggactgagaggatgaggtcacaaatggcttttttctctgggaaggaagccagtggtgtgtgagttgtggcttgggttccagatcttagatcagttttccttacacacaatattaacgttcatattccttccaggaaactatcaagagtaaatggatcaacaggcagccaattggaagagcctcagacatagcaagagggtggcatggagggagaggacatataaccctctctttggcagctgtgcctaccacactctggccttgaagattctgctttggctcccagactagagacccttttgcatctttgccatcagtctttttggaatacagcatcaggcctaaggtcccagatgaaccttaggacagctttcattttgaaaattttggttctcagttcacattttctagctttccattgagtggtgtatcagttagctgttgctgtgtaacaaaacccctctcaaatttagtgacttcaaagaataactttttgtgatttgtgccaagcctctgggttggctaggtgtttctgctagtctgcactcactcatgcatccatcaccgcagtggcagggtgacgggcggagagctggtcaaggatggcctccaatagatccctcatgttcttccttccacttctttacatccttccataaggttcacatgggcatgttttcctggcagtgggtccaggagagaaagaaaaaacatacaagtgcttctacaagctgctgcttatgtccagtttgctgctgaaccattaggaggcgagccccgggaccgtgccccgagtcagcgtgggagggcactgtcacaatgtggagccactgatcccatcactctgccattgctggtgaaatacaaggaagccagctgacagcttccgacgagttgccagatgacgtttcttctgctattctttcatgtttagtagtgtcgctttgtagcaacacgttatgtcttaatctgttttgtggttgagatgcacctgagcaggcatctggactaggtgttttaagtagctaatttttctatctcttggtcattttgtcgtctcacctattgtgatggtgatagagccccaggaatacaaacaccatattccaatacagcatgttcagaagaactgaataaaaggcatacagatttaggaagaaggagaaaaaaattctccatggagaagaacctcctgcttattttaggttttattttattttatttttttgagacagagtcttgctctgtcaccaggctggagtgcagtggcgtgatgttggctcactgcaacctccacttcccaggttcaagcgattatcctgcctcagcctcctgagtagctgggactacaggtgcccaccaccacgcctagataatttttgtatttttagtagagatggggtttcaccgtgttggtcagggtggtctcgatctcctgacctcgtgatccacccgcctcagcctcccagagtgctgggattacaggcgtgagccaccacacccagcagtaattttatttttaagatggaagggtgaatgaaggaatatttgttagcagtgactacacagagttccagtgggctttctctgtgttgaagtaggtaggaaggtgtagggaattggtaaactccgactattttttgttttgtcagtagagcgtgggaaaacggctgattttcaaattgttgtgatgaaacgaatgctggggtatttataggcatgtgtaaataagaagaatatatctttgtcaaaaaacagccaccatgttatttggagcttttttaggtagaataaagtagaactttctaaaagtccgaggaaagatagaggaagattttttaaaaacttgacaccattaatttctgctttgtccaattcatatttatagcatttgcatccatcatctctttaatagttcggttcggtctgagctagttatttctttcacatatttccttttttgttcagtgctaataattacacttttgttctcttactggcaaaacattgcattgtcctcgggaagcattcaaagagactgagcagcaaacgctaattaatcctcgcagtgtgtctccttcattcctttaactgaggcgctgaaatgtctagccacacatttaatgaaatataatttggtgacagagagggtacgaaaactttaattcaagatgccatagcagcttcaataagcctcatatggccatggttgtgaggcagttcaaggctttaaatatccttgagatgcaggtgtggtgactagattatctttctgtgttattctccctttctgacagcagtcatcctgacttgctgtggagaatgagtttatcttgagtggaagttatcctggagtctagggaggcaacctagtttatagcaagtaatcttgggagttacaggcttgtgttttgtttccgtttttgtcagttgtctacacgttgacaagtgacttcatccctgggaatcattattgcttatcaccaattaaacacaatggatattaggtagttcagtgatgagcttaaaagagtttgacaagtttcttggaaagaacgttaggtaactatggatggctccctgtgcaatgtcttaagtctttaaagaatattttaatttattaccttatgtccttaaataggtcccttgaaccaaatttagtatcccagaatatgcattgtcctaagaacttttgcaggatgacatggaaacagatactataattgggaagcctcctaaatatgtgcaggtaggtagtggttataaattatctgtagcgtctcattcattagagactatcttatgagttagtgtgcatgattgatttgtagaaactacagataataagaatgctgtctttgctttaaccggattcatacagtcttctatccagggctggaagttacaagttgccctgctctggaggtccgagtgctgagcagtgagtgactgtagacgtgtggcaggcattcctccctccttgaatcccatgtttaaggtctgtgtttacctctagcccgcgagttccaaaagctatgtctgtctcacttggctttgtttttctagcccttactacagtgactagtaatgaagtaagtgcccaaacacagatgtatgaaataaagagagaaatgaaagggcaaataaggaaactggacgttgcttctctctgttgtacttaaggcctgttgcttcacggcccttccctacaggaggctgtaacactcataacgccgattatgactattgtgagaacaaattggcttccagatctgaacagaatcgcacataagaatcacctaggaagcctgttctggagtctgcccagagctactgaccgagatctccaaagactgagcccggagagctttttattttcaaaaggctcccaagatgattcagatgtaagtgctctgaggattcatgctgggaacagatccagatctgctgtaagccctggctgtgccctggacccacagctcctttccttgcccaggctccccgtgagatgaaggctcgtggaacacatctcatcttcttcatggcaggtaattggaatcaaggagctatagttcccttacctatagtaacatgctgaaaattaaaaccatagttgttcttacatttctttgtatcattaggtgccccactgccaggcctattagcagagacctaatacataattggtgttctggaagaaatggaaggatggatacatgaattctgtgacttaaaaatgaaatccacatggacatacctagatcaggaagaatgttgaatttgtctttacacaaattagcatgaggaaatacttctaccccaaattaataataggtcctgaaatccatttttagactttaatccacttatagatggtgttaagaatgatccttgaaaagggatgtactttagtatttgtctgttgtagaattgttctttaactatcaagtcagtacttcagggttaaacattacaagttcaagatactatctaagattagttaccatctgcagcttaaataatgtgtcccttcccaaactccgtcaaatgaaataaccattaattaaaccccggttcttttccaattggaggaaggctgcaggccaaattatttttgtgatgtatgggacatctgtaatgagtgccgctcaagtgtacctgaagcccttcatcctcagtgcataggactggagcagttgaacagcctctgtcttataaacagattatagtattgttaggattagccagcttttctttggcaatttttttcatctcaagtagtccatattttccaagttcagcacgtagcaagcagtcagtcctgttcttggctgaagtaagcagtctgccttgagtgccctgtgtctttcattctcccgacgtgcacatcccctatgtgttcctcattctccccatgggtcagttaagacctctgtaattacagaacgctccctcaagctagtggagaatgtataatttggaatgtagaggtatctccagaatcatagggcaggagtccagctccattaattgcttttactacatagcagcttgtttcttctcaacttaaaaaaaaaaattaattgtggtagaatgttcataacataaaatttatcatcctaaccattttatatataattcaatagtgttaagtatgttcccattgttgtgcaacccatctttagaacttttttaccttgcgaaactgaaaatctgtacttgctaagcagtgactctctgattccccttcccccacagccccaggcagccatcattctactttgtctctatgagtttgactactctaggtacctcatataagtgaaggcagagagtattttgactttgtgtgacagacttatttcacttggtataatgtctccaaggttcacacatgtggtagcgtgtgtcagaacttcccatttaagactgaagaatatttcactggatgcatagggcacggtgtgtttacctgtttatccctccacagacactaaggttgttcccacctttttgctattgtgaatgatgccgttatgaacgtgggtgtacaagtatctcttcaagaccctgtcttcaattcgtttagatagatactgagaagtattgttagatcatatgataattctatttttaattttttaaggaacctccatactgttttccgtagtggctgcaccattttacattttactttcccactgacagtgcacaagatctccagtttccccatatccatgtcaacgtttgttattttgttatttatttatttattttctaaataatggccatcctaatgtgtgaagatgaacctactctctcattgcggttttaattccattttcctgatcattggtgcaacttagcatcttctcatatgctttttgctcttttgtaaaccttctttggagaaatgtccattcaagtcctttgcctgttttttaatcaggttatttgtttttctcttgttgaattgtaagagttctttatatattctgaatattaaccccttataaaatatataatttgccagtgtctttttcttattccgtaggttgcattttgaccctgttagttttgtcctttgatggcacagaatttttaaattttcatgtggtacattttatctacttttattctcacacttaatatataatctagttacttcttttattttctgttcttttaaaaactttataatgagacattaaggttttgttttgttttgtgagacagagtcttgctctgtcgcccaggctggagtgcagtggcacgtctcggctcactgcgagctctgcctcccgggttcacgcccttctcctgcctcagcctcccaagtagctgccatgcccagctaatttgttctatttttagtagagatgggtttcaccgtgttagccaggatggtcttgatctcctgccctcgtgatccacccacctcggcctcccaaagtgctgggattacaggcgtgagccaccatgcccggccacattaggggttctttttagctgctatccccagtttaattcctctcttccccactactgtgggagtttttctaagctttactgaggtatagtcatatatatgattatatatataaggtatacagcgtgatgctttgatatacatatgtattgggatattattatcaaaattaagtaggcacattcatcacctcacatagttaccattcttgtgtgtgtctgatgagaaccactaagatctacttttctaacaaacttcaaatgtacaatacagtattattaactgcagtcaccacgctgtagcttagatcctcagaacttttgcatcttataactgaaagtttgtaccctttgacgaacatctgtgcctcagccttggcaaccagcattctactctctgtttctaagagttgtacttttttagatttcacatataagtgagatcatacagtatttgtctctgtctgattccactcaggagaatgccctcaggatacatccatgttatcacaaatggagggatgtctttctttccttatggcggaatagtattctaggtgtgctctgcagcctggtggagtggcaggctgtgccctgcagtcgggtgggggaaccctgacaggaccccctgctgggcagggccataggctgggctccgcagttggaccggactgctgtctgggctctctggtcaggtggtcaatggggttgctggttgatctccctgtttgggggtggctgcaggctgtgctctgccgctaggcagtgctgtggtctgaactctgtgccctgggtggtgcaggggggcgtccactgtgttccatagctggtcagggtctctggctgatttcaggctatgctgctctgctaggtggggcttggctttctgcctgaggagagctgtaggctgagccccagggctgagccagactgctggctggggactgatggtgggcagagctggtgactgccctccctggccagatggtgacactggttcagctctgtgggtgcagtgccactggctgcgccttctggtcaggcaactccactggcagggatttggtgccaccactgagatacacgagctagttgctttgagccccatccttctttgttcctagccaaccccaggtggtcttattttcccagtgttcctgtgagacaagacagaaggaggcatcctgggaagtaccctgcaatgctagggaagctggatgtccaccttaggctctctttttccctactggaaaaacatagcttaggggaagtctctttgtctagtgctctaccagactggggaggggcagcatgaccaaaccaaatccctccactcttcttacccttctaatgaaacttttcttggtttctgtggtccaaggggttggttctgcctcatccccttattctgggatttccacaaaggtgttttgtctatagatagttttgctagttggttgttttgtgaggggacgaaagctggggacctcctcttctgccgtctttcttttgttgcctgtccttttcttgttacatccaagaaatcactgctaaatccaacatcgtgaatcttctctcttatgttttattgtaagtgctttcaattttaggtcttaggtttaaatctttgttctgttttgagttaatttttgtatgtggcgtaagataagggtccaccttcattcttttgcatgtggatgtgcagttttcccaatgccatttactagagactgtcctttatccattgaatggtcttggcacctttgtcaaaaatcatttggccctatttgccagggtttatttctgggctttctaatctattacattggtttgtatgcctctctctgtgccactactatgctgttttgattactgtagctctataattcattttgatatcaggaagtgtgggacttcctatcttgttattcttttgcaagattgttttggctttttgaggtaactttaaattccatatggcttttttatttctgcaaaagaaaatgccattaggaattttagcaggattgtattaaatctgtaaatcattttgggaagtattgacatcgtaataataagtcatctgatttgtgaaatgggatgtctttccatttgtgtcttcttttatttctttcagaaatcttttgtagttttcatagtatgagtcgtttgcctcctttcttaagtttatttttaagtattttactctttttaatactattgtaatgaaattgttttcttaatttccttttatttgttgttaatgtgtagaaacacaactgttgttcattgtgttgattttgtttcctatcattttgctaaatgtgtttattctaacaggttttttgtggaatctttagtgtgttctatgtataagatcaattatttttgtttttttgtttttttaaaatatttccttatttttttcttatataagatcgtttatctaagaatagaggtaattttacttcttcctttctgatttgcatgcctgcatagctaatccttggttgactgtttttatttctgaactttaaatagatcatcccattgccttctggattccatagtttctgatgagaagtcattcattcatcttatttgctgttcttttcttgacaagtaattgttttcttactgctttcaagattttgttctttgccatttaacagctttacttttatgtagctgggtgttgatatctttgcatttatccttcttagagtttttgagctgcttacatatacagaccattgttttatattaaatttggtaagtttacttcattatttcttcaaatacttttccagtattctttctgttactttcccttccatcttctatttctattagttgtgtgttggcacacctgttggcatctcatatttttctgagactcttccttttatttctctttgttcttaggattgagtaattgctattagcctgtcttcaagttcagtgattctttttctgcagattaaaatatactgttgagtccctccagtgaatttatttgttattttaccttttaaccaaaattaatacttttaaaataattttcatcttttaatattgtttgttgagacgtagttctcatactttaattctttagaaattatttatcttttaaaatataattaggatagctaatttcaaggtttttttctgtaaagtctagcataccttaggggcagtttctattgattgctttttttcccccgtgtatgctccataccttcctatttctttgcatatttcataaatgttttttaacaactgggcatttgaatgatataatatggcaattttggaaatcagatttcctaccctatgcagaatttactttttatattgcttctgtctgttaagtgaccttcttaagataattctgtaagatatatattctatgtatgtttagcctctgaagtctcttgtcagttagctaagtggtcatctaataactggatacaggtttctttaaattatttgagggataaatctccaagcctttgggaagggacttgtgtgtgtgtgttgaggcttgcctgctatgtgctggcaggcagtttacaaccctccacttgcttgcttagagccagaggtcagtcagaggtgacgtacactgtacgtcaaattgtatgtcagtctgtcatgccagaggtgagatattagagccttttccagtgctttttctggacatgtgcttagccctgtacatgtgtgtgaccttctgaatttccaggaataagtcagagcagttcagaatcccctatggccatgtcattctccagtttttccatttaaggtttttggtctgttgcttgttagccccagttcatattgctgcctcagggaactgtgatattgagcatgtgtcacagattgtttgccctagggatagggctttttgcacagatacaggtcagatttaggtcagatacaggcaagcctaagaatggagcttttgaaggcagcttcttgacagataaaatagtaagaattatctgtactatcccccttagtggcttcaaggctattgtttttcacagctcctgtagttgcaagactgttggttttcaagggtcctgtggaactagtggaaggggtatgggaatagggcaagttaaaacactttatagtttgcttattcttaacaagattcgtctgtttttcttgaataaacagtacttagattgttgcaagcctttgattaatttttagagttccaaaaatgttgatttcacaatttttgtccatgttctcattgattttatgaaggagatgattttcagagacttttattctgccattcctgaggtccttcttttctcagatgacattttgtggttcatagcaaccatagaaacattctgtagttcatcaggtgtggacacagggaagggtcactttgtatagaaaggctatcagggacctatccttgtgattaatctacctgttgcctccctctggagcctcatggaatgtggtgtctgtggattatagaaaacttggcttccttggccacatctccttgaaaattccatcctgccacctcctgtataccaagtggatgtgctgagcactctctgaagtgctaagaaatatgtcagagagcttgctgggacagtctttccctctaaccatgggactggccagtgtgttttgagtttttccagccaatttttggagtaaccaaaactttaggaaggccctgtcagcccacctccctcactggcacactaagcaggaatccccagccccctgttctcccagctcccaggggatgctcttcatctttgctctgtgatcctgcagtggtctccttgtgtgggaatcgtgcaccccactggccatgccatatctgtgtgaagcttattttagctgtcctaatcagagcatgattaaaacaattgatttttaaaactgttgtgtatgtattttatctgtgttattcttgaatattggattcatattaaatagtagtttgccctaattaactttaatactacagatttgtgctttttgaactcagcatgcagatttatgtaaattgcataaagcctttaagctaggagtgtatcatttacatttacaatcccatttatcccatgtctccatatcactgactcttcaaagaaagacaggaactattgggatggacgtacttgattgtttcagtttcactcctgtgcaaaccaaagaacaagtagtaaatgacttttccacataaacacacacattcacacacacacacatagatgcttgtgtgtatatacgtgtgtgtggacctatctttggatgctcatatatgtgcacttagagaatcaaaagcaatatccaggtatcttgaccataagcccaataccctgtctatttttttgagtggcaatttgtgttcccatattgtagtgtgcatatatatatatatatatatatatatgctgtatttttaaactgattttagaattagcgcttaaaatagaaaagacagagcacaaatttggggggggagcagtttaaattttgttttcatacatctggttgtattaaattctctgttcctctttttttttttacccccatttctttgcccttctttcttccctttcctccccaatgttttccgtatctctggcaaagttcatgacataaagggctgtaagagatcagattatgttaccccaaaacacaccactctggcatacagattacattgagctgaaaacagttaagaaaaagacacaagatgagctctctgccttttcccgtctgcctgaaacataaaattttccttgtgaacgtgttcctcccagctctacttccggtaaggagaatttcccagaaaaggagtaacagcctcattactggagatgagaggacaccagaaagggcttacacaaaccagccctaggagccagccatcatctcccatcagtttctcccgacatttgcatatttgccttcatacagtctgccacccctagaagttcaaagtccatttcctttgccatgtcacttctctttagcatttttgtcttttttccaaatagtataaaagcttccaagcacagccattcttatgaagtcctcctcccacccctttctgtgtaaaacttttaacaccaaataaaattatatactttttattccctgtttgtctgcctgttgtcagtttatttcacagacccagtcacagaaccaaagagggtggaggaaagtttttcctttcctacaaggtcagtgtccttttggatagaggtcgaatggatcggttattggaaaagaaacccacagagaaatatgttagaaaggaatttttgcaagcaaagaaccaaacaaacaaatagcaaattgtacgtcatcagtggagactggttttctaccagatgaatgaccctcattaacatgaggaagcatgtatggatattcagtacacatggtcctacttattgataggcatgaatttgattgtacggaactttcctggagcaatgtacgtgttgtgtgtcaggaaaggctctgttcaggaatgcgataggccttgggtgccttgaatgggagagtaatacgtaagcagaccaactgatgggaaaagtctcaatatagaggtaagagagggtggggagactcatgtgaggggtagtttaaaagaggcagtctgttaagcttatgcctggacgtaaatagcagatgaatttggagttagaagaagtttcttggctttcttggtgaggtttgagactcgggttctgtggcggtacagtcttgctaagtcacagatttttgaacccaaaacattcagcccattctccttgtcacaactctcttacctcttttctcatgtaggcttctgtatacagagctagaactggcaagttagagtggaccttttactttaattgtggaaggagggcaagcagcccctgagaaaataagagtctctaacaaaatgcacttataccctccagacctgtctactttaccagaatgggtgtgccgggatacagaataccctagtaccacaaaataacttcaactgcaaacaattaaactagtaagtatttaaggaacatttgctatgtgccagaaactgcttagtgctggatatgtattagtcgttgtaagtagatgtcggaggaggaggaagagggtatatatcaccactgtgtgtacgaaaaaaatgatataaagagttgaaccgagtggcatgatgagaaaaacttctgcttggatatcattgtatgaaagggcgatgcctggaccttactggccacaagttagcagctatctgcccccatgaatggatcataaaagatgtcttccaatgtgctgacatcatgtagccacaggaccaatgctggaagaatttcctgtggcgttattatcctgtgtaattaataagacactattaatcaacagcttgactcacagattctgtgacttgcatccaaagcccactactggatgtctcaagtctttgccatctctcactttatttcaatagcctcctagtttgttcctgcctcaggatccttccgcttgctgttcatctgccttgaatgctattcctaagatttttccatggcctggtgccccactttatttagttggtttctcaaatgccatctcccaagaaaggtcctcttcatccaaaatagcccccctccccccatctctccaattactgccgaaccccttacgatactttgactttctgcatagcacgtatcactacctttctttccatatatacatttagcttctttgtctgttcattgtttgtaatgtctattctattataatataagcatcattttgggcacagacttcatctgccaaacatatactaggtatccagtaaatccgatcaatgaattcatacagtataacctagcaaggaatatcatcaatgaaaaaaagaaaagacacaaaagacctaaaagaaataagaagacaggccaggcatggtggctcacgcctgtaatcccagcactttgggaggccgagatgggcagatcacaaagtcaggagatcgagaccatcctggctaacacgatgaaaccccgtctctactacaaatacaaaaaaattagccaggcgtggtggcgggtgcctgtagtctcagctactcgggaggctgaggcaggagaatggcgtgaacccgggaggtggaggttgcagtgagcggagatcacaccaatgcactccagcctgggcgacagagtgagactccatctcaaaaaaacaaacaaacaaaaaaaaacaaaaagaaaaagaaaaacaatttaaaaatagaaaacaaacaaaaatgtatagtatatccaaaataaagaactgctttttttgtggttatgcttttctttttccctcacgaaggccaaatctcctgtgtgcttcaatagaaatcagtgatgagaaaaaagtagcaggtatcagattaaaccggcctccatgtgatgatcatctgttagctttagtattgtctcaaatgaaaaactcacaaaacactccaagttccctgccattgctgaatttaatctttggaatgttttgaaccccgtgcatgaattatatcaattttacttagggaaggtcctgtggtatctcaaagtcacttagctcagtttctctaggttttgtgggaatattaccctttaggtatgtaaataatatttatttcaaatcaaaatcataagtgaaatcctaaagcattgctattaaatgtctaggctaaaatgaagatacctgcttttgccactactattttgaaatgtagactcacaagaagttgtaaaaataatgcacagaatcctataaaaccttcaccccacttctgccagtggtgaaatgttgcataactggagtgtggcataaagactgagaaactgacatttatataatactgttaactagaatagaaacgttactcagttttcactggtttcagtatgccctcatttgcatgtgtgtgtgtgtgtgtaaataattctaaattctatacaatttgatcctacgcatagattcatttaatcgcctccacaatcaagatgtgcaactgatccgccatgacagaggaactccctcgagcgacccctataaaactcccctgttgcaccccctcccacctcattgcccctgccgtttaacattgttttcaaatgtctagccaatataattagccaagataagtagtagtaacactattggcaaagaaaagtgagaatgaaacatatcattatttgcaaatgatatgtttatctcttgagaaaaatccaaaataatggattgaaactattaatttgagattttctgtataattatgattaagaacatacactctgaagcctgctatgtgggtttggatcccagctccaccacagactagctgtcagtcctctgggaaatcacttaacctctctgtagaggtttccctcatctgtaaagcagggctagtaagagtacctacctcactgagttgagaggattaaagaatataatacaggcatacctctaagatattgtgggtttgctccagactaccccaatttgcaaatattgcaataagtgagtcacatgaattttttggtttccagtgcatataaaagttatgtttatactatagtttattaagtgtgcaatagcattatgtctaaaaatttacataccttaattcaaaaatactttattttaaaatataatagcaatcacctgagccttcagcaagtctttttgatggtacagggtcttacctcattggtgatggctgctgactgatcagtctgatggttgctgaagggtggggtgactgtggcaacttcttaaaataagacaacagtgaagtttgccccatcaattgatgtcttcctttcacaaaagatttctctgtaatgtgcactgcttgctgctcttttacccatagtagaacgtcttccaaaattggagtcactcctctcaaatcctgctgctgctttatcaactaagagtatgtaatgttctaaatcctttgttgtcatgtgaacaaagttcagagtgcctccaccaggagtaggttccatcttaacacatcattttctttgcttatccataagaaatacctcatcattggttacagtttattatgagattgtagcaattcagtcatgtcttcagactccactgctaattctagttctcttgccgtttctaccacatctgcacttacttcttccactgcaatgctgaacccctcaaactcacccatgaggggtggagtcagcttctcccaaactcctgttaatgttgatattttgacctcctctcatgaatcccgaatgttcttgatggcatctagaatgatgaatgcttttcagaaggtttttgattgacttttccaagaccatcagaggagtcatcatccgtggcagctatagacttacaaaatgcatttcttaaatagtaagacgtgaaagtcaaatttactccttgattcataggctgcagaatggatgctgtggcatgaaaccaacattcatctccatgagaactcttgggtaaccaggtgcatgatgtaatatataaattaggaaactaggagagaaaaatccaggcatgataatagaaaattttgcaaacagtgtgacacagaactacctaggtaaatagatggaaaaagtcattctcactggtaattagaaatgtattttataccataaccaacatttagtttctactacccaataggcaagtctttagaaaataatgacataacaaccactgtctgtgtgtacttgtaagggtggagtaacatgtttgtgctattttcttgcaatatttattgaaggcattcaaagtgtatgtaacattctgacagttaaattttaaagaattctgagaattgattagatgcactgtggcttttgtttactaagattttatttatagtcattcttttatttagcaaatgctgtcgtgggccttgtctatgcaggacagcatgctaagcactaggaatagagtagtgatgaaaacaggaagacaagcattaaataaatcatggggcaaagggaaataatcactagtgttgaaagaggaagtattgtactaggtagctgagggcctgtaactagaggatttaacttagcctggggtgtgtgtgtgtgtgtgtgtatggtgaggggttttcactgaagagttgatgaatgttgaaacgcagaggagtggtaagaggcagggaggagggaagggaggattaaggtgtgaggtaaccagcagcagaccctgtacagggaggctggaggctggagcagagagaggacatgacggggtgaaaggtaactctggagatataggaaggggtcacagcaccttttaggaaaatctaagattttagccaggaaactgatacgaaaaataatgttttcaagggagatttagtaatacaattataatgatagaatattagtatatatttgattatactgtatatcacagttactatatgtgttatagtatgtatcatgatcattatatactatataaccattaaatgatattttaatgataaatgatgacataatagttaatgctataatattaaacgttgaaagcagggtacaaaacagcatgtttggtttaatcctaattttgaaaaggaaaaatgatgtatctaacatacactgaactctaaattgtttttacggtgatttttctgtgtagcaggatagaggctgcttttttatagttcctttatttcccggattctctaaaaatgaataggtgttactgtttacttagaaaaattgtactatttgagaaaaacagatttagtttatcttggaacatttcattgaatagcctgtatatattataacgggcttatggaataatactgaaaaatatccattaaatggcgagtagtcaggtccagtgttggcttttgtccctgtgaggtctccttcactgtgtatgtttccattaaggacccttaaggttcagagtttttgttgaaatacactattcagtcacatggatctgggaggaaaactgaaaccagctggccttgggcagttgctttagaaattctaatacatgttcagtttcctcatgcttcatgtattgaactgtaaaaattctcttttggttaccatcacacaatcacagggcaaattaaatctcatccctgtttcatttgactgggaacaaaaaacaaatcttaaaatttaagagtacttggtacaaccctataattactatacataaatccaaggtttcaggtaccgaatgcttttgttttgagattacagcatcaccgttgttcaggtaaatatgattcatcctgtccagacaattttttgttgttgttctacaggaattcattgacaataataacattctagtttgtggtaggtttcagtatactaggaaaaaaaatcaaccaaccaaccaacccaactcacacttagatggagacatgccagtaatgcgaatattttcaacagagcatattctcactattctttgccttcagaatttaatcagatgatataatagataagtacatgaaagaaggttaaggagaacatcacctcttttttttttcttttgagagggagtctcgctctgtcacctaggctggagtgcagtggcataatctctgctcactgcaacctccgcctcctggtttcaagcaattctcctgcctcagccttctgagtagctgggactacaggtgtgtgccaccacgcccagctaatttttttcttttttgaaatggagtctcgccctgtcacccaggctggagtgcaatggcacgatctcagctcactgcaacctctgcctcccaggttcaagcaattcccctgcctcagcctcctgagtagctgggattacaggcgtgtaccaccacgcctggctaattttttgtatctttagtagagacagggtttcaccatgttatccaggctggtctcgaactcctgacctcgtgatccgcccgccttggcctcccaaagtgctgggattagaggtgtgagccaccgcgcccagccgaacatcacctcttaatctgatgtaagaaaagtaatcaaagttctgatacaaggatagaagtgactgctgcccttcagcctcttgcccctgtgccagctagctcatagttaaaccttggtgcagagagagagagaaagcacctcgtgggctggcattctagtgttctggtctcctgtattctaatggtagtcatggaccctacaaatcccaaggcagaagctgtcttggtgtaaaatagcagcaataaaaattaatttagactgagtcagtactgtaaagaagaaacaaaaatgaaaacaaaatctcacctttcccagctgtgtgaatcaatataaattggttcaacatgagctcttgttagaatctgggtgtttttcacactttgtaatacaaagctcacataggctttacagatgatggttaaaacgtgtgtgttagggtccaataagtgacttctttgcctagcagaaaattcacctcatttattgaacaaaattggcaaaaaatgtttcactctgaatgtttggttattttgactggttcaattaaaaatcacttcttcgtatttgtttatcattgcaaaagaggactggagagttagaacttacatctctaaaagaaggtgtttgatttaatcagaaaagtgactatttggagaacaaggactgggaaagaggtgttaattgcattggagaagagtggcaaggaaactaaaccatttaatttcgaagtctactatcctgtgctcaatccacaagcaggtaaagaatgtaaatttataatttatatgcactgccttctataagtaatgttagagaatcaactcttcagtgatacttgttaaagaccagtaaggaagactttatttaggaccattgcaataggtataggaacagcgggattttgcagtgggcgagagagattgagagggattgcagagagagattgagttcaactccaaaaacagcataggccagtgggaattcatagccaaggagtagtgtgggggtcagcggatggaaaatgagcaagaggaagcatcagcgctctgactgaactgatttaactgagttctttgctcaaattggattttccaaagaaatatgcagataagtctaggagaaggttcagaagccccactgaagtttggccatgcaaagaatctttgtcagtaaatactagtgaaataaatgaaatctgatagagacaaataggatacgacaatctctaatcctgccatgtctttacacctttctcttttgcactgatcctgcttcagttgtgaaactgtgcctggatgtagcgctaacagcacagaagaggtatatgtcaagcctgtcctctttatgcgactgttttacctccctgcgggtgcagaatctttaccttttgagaactgtctttttccttcccaagagtgggcctgccccccaccatcagcaataccttcgagctccaccctgcagccactgtcacaaaggaaggctggggaccttcttgctgttgttggtcccactcttcctccagtcgctgtgtggctaccagcctgagggctcttgctcctggcattacaggacattcaagcccttactaaaataaaactgacattttagcctgtgttttttatgagtatttcagtcttctgaaggtctgatgatccttctcaaggtatcaaataagagagctaataaactaggatgatgcccctctttacttcctgtcctgtaaaccttgaagtcagcacctcccttcatgaatccttgctgctgcgtcgccctctccaagatgctgcctatggcaaactaaatgtgagagatagaaccagaggacaagatagaagaacttcggcggggggtggggggaggagggaggagggaggaatggggagcagggacagcactctggagagtggtccagtgcctccaatgcttcaaagcctggccatcccgtcattgcccagtaaggatgctttttacaggcctggatcatggtcagggacaattctgatagccacaccgacttcctcttcaaaggtcctttttctcaaaagaaaccatttagcctttcagggactgcagtaccgagctctgtgatccagcacagctgacagatgcggaagggggttccagtcaaggaggcttccaaccagtgccctgaggtcaccttgcctggtgattgacacccttgggctccagatagccctccccttccatttcctctgaggaccgctcccttctgaaagccctgggaaactggttttctacttcctttctttttctcattccgtgatgaaatttgtgtggttatatctaatattttgaaacattacaaacaatggggaagagacgaaagatagtgtttcatgggaggtgtatttgagataggcagaagaggaaacaagctttcagccaatgggaaaagtactcctttggccttctatgattgacatttcagaacaagcttttgggagaaagttaaccaataaacactttctaagttactgcctgtattattgaacgtatattgcacttttcgttttcatcttgcacaacctgataggtgagcctgaaattggctctgttaactgttctccattagcttttattcactcttattagggactgcagtctatgtaatgaatttattggatcaattatttgtatcttaatgcatgtttaggacttcaaagacccctttcttttgatttttttcctcatttaaatagttttctgaacatcacagttttggtgccttcactttgatacataattactattctgcaagtgagcttaatacttttaatgccatctgacctcaagattttaatagaattaaatgcaaacaagatgaggaaagaagagtcatggggaaacttgacttgttactgagctttgggaaaaactttaaactcttggtcaaagtgattttctgttaagaaatcaaaaacgtgccagcagatgcctttaaagacaacatttatagaaattatttttttttgagagtttgattttagtattctagcatggatttacgtcatctgatactggatagtataatcttttttcctcatcctctaaccctcaattcttaaaactccgtgaatccatttctttctttgcatttttattattgtgcatcatgagactcatcttcaaaggcaagagccttattattgggaaacaattgtgtagtaaatgcttatttgttatttctctctatagttttttctctatatagtatagtagtatctctattatcttaacacagtcttggaaatacccacagtatttgtaataaatgtataataagtatgtcaaatttattttctatctaaattttgttgttatctcagtcttaaattccatccctcccaaattgctatttctccaccctgaaagataaagggtagcccacgttgatactactcggtgtctgcccaatcacaggaaggcactgagatctttcaatgtactgccatcacatcactaagatgggtgaggtggggatcaaaaattgagagaactaggatggcggcaatattttcaggaatggtcattaataagctagttatgagattgtcatatttaaatttcatgactgtttttcaacctgaatgtatggaaataaaaattataaaccctcttcattttatgaaccttatttttgaatttccctggaatctattgctattaaagccattaattccttactgtaaaacgtcactatcaagaaaaagctaaaaacatcaccatcagtattagagatgcaagcatgcaggtttcctaaactgaagagacattgccccttaatgagcctttacaaaacaagagaagatcatttttgagcttaatattagaaccaaaaagagaaatgcaaggcagtagcccattgcaagaaagaaaacaggaatgcactcagccaggttgcagtcacccccagacaggaaggttcttgccgtttattgcagttgcctctgattcctccctcgaagtctgggagccttaagggtgaacagcctacaaccaagccacgttctcccgacaattctgtaaacctgtttatcacaggcaaattttcaggtgtctgactatagtgggattttttattatcaatgaaatgcatgaagtgacaggccttggttggtgaagtggcttttgtagactgaatatggctgagtatgtacagccaataatacattttaaaaggcatgtttccacgtagctagaattgaatacttggtattactgtccttattttcttctttttactgtatttgataaaatacgtccatgagaattcagcattctctataaaataaaattttgaaggaaagtagaatgaaaaataattaatgatttgatgaggaaaatctaaaagaaatgtgttatttctaggcaggtcctcttggctttccattcaggacttctgcccaaaccatgaaagcaaatgactaggccatatggaaattggttgtaaaagatgttttagattagccagtcactccaggagcctttgatgttatgcaggctaatgaagttggctcttggagaggtttttattcagctgaactgaatttctgagagattcatattacattttcatacagttgtcttgcttcataccccagggatttattaagttataattgaatattgtgtttttaagaaagtttcttaatgtattacacccttcagcaaattttgcttggtattgttttgtcaagataatttaattttacattggctaatttagcccatattaatatttcccctgaaattcaggtaacttagcaaactgttacaggtggtgagaaagaaaactcttttattgaagcattaaaatgttacattattgtgaggtgaaatcttttatcagcctttggagatattctatcaaggtcagtaacattgtatctgtcaaagaaaagttttactccaaaagttgattctcctttcctcagtatcccctgttccctgcattctccagtgttcctccttcctcccatctcttcctgtcccagggaagttctccccggattgctgactggagaaacagcatgacgtggtttctaagtaaggggaaggggggtggggggcggagtactcccttgtcagtggtaacaataggctgtgaataattcagacatgatgaaagaaagtctcatttgacaagatagtacccgattcactaaacagctagtgtggaaataatgatggcgttagttaggggaatacaagaagttcaaaagttttggtggttttgaaagggaatcgcagcacaggggccttcaccagcttcccttctaatgttcgtttgttacgcctggagtttcttacattactgattacgtctcacttgggcgatgttttatctaatttctggaaaggctttgttttataaagtgggcttgcttctgtggaaataaacaaagaccaaatgagaacaaacagaggctatttattcagagcttgctataccaagggagccatcctttgctcttggcagagactcaaaggcagccagaggggtgggaaagcttccaagtgaaagaaggaggcttccagctcactctgattggaggctgttggcctggggaagccggaagtgggcttactagaaagggggcgtgttgtgtggttggtgtggggagcgtatttggcttcctctgattggccttgagttggaaagggttggggagcgaaaatagggacgactcagtcactggccaagtgctgactgttcggtgcccatgactgcagaggttgtgttttggcttcctgggtttctcacgcgggtgggagttgacatacacggtctggccattgtctgtctgcatagtccgcctcactggatactgagaaatttgcctggcagtgtatgaactggataaacttgagtgggaagtctaaaattatgaaggatatttggacagaatacttaatttttttaattcgtaccccacactattcactctttatgaggaacagagtctgataaccacctccacagccaaaatacagaacgtcatctcaaaaaagttctccgtgtcgttcatttgtaaccaactccttccccccaacccctcaccccaaacaaacgctgataggtttgtttgcccctgtaattttgttattttcagaatatcacataaatggctacatgcagtatggagctttttgaacctgagtcccttcacgtggtatagtgcatctgacacatgcatgttgttgcatgttttgaatctgactcctttcacatggcatagtgcgtgtgacacatgcatgttgttgcatgttttgaatctgactcacatggcatagcacgtgtgacacatgtatatcgttttaactctgactcctttcacatggcatagcacgtgtgacacatgcatatctttgatgttttgaccctgactcctttcacatggcatagcacatgtgacatatgtatatcgtggttttaaatctgactcctttcacatggcatagcacatgtgacacatgcatatcattgatgttttgaacctgactcctttcacatggcatagcacatgtgacacatgcatatcattgatgttttgaacctgactcctttcacatggcatagcacctgtgacacatgcatatctttgatgctttgaccctgagtcctttcacatggcatagcacgtgtgacacatgcatatctttgatgttttgaccctgactcctttcacatggcatagcacgtgtgacacatgcataccattgatgttttgaacctgactcctttcacatggcatagcacatgtgacacatgcatatcattgatgttttgaacctgactcctttcacatggcatagcacatgtgacacatgtatatcgttgttttaaatctgactcctttcacatggcattgtgcgtgtgagacatgtgtgtcattgcatgtgtgtcaatagcatcactagtttattccttttttttttttaaagaaaatgctcaactttatatttcatttcaacaatttgctcctaatgcccttttcctgccccaggatcctatctaagaccttgtgcgtgtagtcatgtcttcttggtctcctccaatctgtgaccatttttactctttctgtactgtctacaactttgacccttttgaagagtcctcgtcaggcatctttgggtcgtgtccctatatttgggtgtatctgttgtttcctcatgcttagactggggttatggattttggggaagaatcccacaggggtaaaggacccttttgatgatatcatatcgggggcaccggtcatcaccatgacttattcctggcgatgcgaaccttgaccctttggtgagggtggtgacagttagggttttccactataaagttaccatttttttttccgtatcctattcttgaaaggttttcttttctcaccagctgaatatgtggtgtttttccatactgattctccaactctctgacaccaactgggtgtcctgcaattcaactgaattacaaaaccaactcccagcgttagcacagaccccacacattgagggctcaaaactacccccacttcagatcccaggtgtcctcatatacatctgacagactttgaatcggggttcccaaaaccccctccttgggctcagtaactcactagaacagctcacagaactactcaggaagtcactttacttacttcctttttttgagacaaggtctctctctgtcactcaactcctggtctcaagcgatcctcccttgtcagcctcctgagtagctgggacctaaggtgctaccatgcctggttaattttatttaaaattatttttaatagagatggggtctcactgtgttgcctaggctggtctcaaactcctggcctcaagcagtcctcccactttggcctcccaaagtgctgggactacaggtgtgagtcaccaggcctgaccaggaagtcactttactttctatgaccaatttattataaaggatacaactcaggaatagcgaaattgaggagatgcatagggcaggtgtgggggagggtgcagtactcccaagctctctccaggcgcaaggtgccccgtcctcccagtacctctgtgtgtccaacaccccggaggctcttccaaccccattgctggagggttttcatggaaggttcattatagaagcatgactgattaaatcgttggtcctaggtgattgaactcaaccttcaggccccctcccctcccaggagactggggagtggggctgaaagttccaagtttctaatcaaggcttggtctttctggtgaccagcacccatcctgaagctatctaggggcctgccaagagttgccttgttagaacaaaagactcctataacccttatcactcatgaaattccatacgttttagtagctctgtgccaggaactgggcacaaagaccaaacgtatctttctcattataccacagttccttagaagcaagttgtcaagtccagcccacagtcaagcagagggcagttaagttccactctgcagggaagagtatcaaagaattcgtgggcatatgttaaaaccgccactgtacttaataaatattctgagggatatactttgaggcaatgcaaatatctgtttttcctaaactttcagccacccattttagcattcggcagtggctcttgcttacagcatttctatcgtaatgttctaacggtgatttttctcatttccctcattcttcctacatttgttttttggaatttttctgtaaaggaaatctgtcccatctcccatttatatattcaatcatttatttatatcattttggatatatgaatatttatgttattctctgggttataatcttctatttaggttggtgcaaaaataatggtagtttttgtcattaacactaatgcgaaactgtaattatttttgtaccaacctaatagatttaatttgtaggtcaaatggctcctactgtggccttgagagctttctccagttggccactgtgtttgtttgacgtgctcttatctttttcttttcttggcacttactctgcactgtgagatcctccagccttgttctgtgtgtcacctgcacccgcccagagtcagccatttctttaagaaccctggtgccttttatggggaaataggattagaaaccaagactgaagcatggagtgtgcttgtagcccctgtgctgtcacatcctctaggcctctcagtggacccagctaggaaacaggtatatgtattccaacccatgtatacacacaagtctctgttcctgtctgtatccatctgtatctatttaaaaataaccgtgagtttctacaagtatttctgagtctaatccagtaccatggggttcattctgttttcctcccttggttacttgtaatttatttctctgacagggagaaacctgactcgcattatccacagtttatttaggtgttcaatggtagcatttgtgtaaactacccttaggattgctgacgtgtatcctgcgagaaacaaatttaccaaccaaaatacaggctttacctatggctcatttttcctttatcctgcaataatcagtcaaatcactgtttcccaaggggtttggatcataattctgaaagaaatgctgtaaaatgctgtactttctgaagtctaaatcccaaaagatcaatctctaaatagaaagtgggaatgtttaatagggaatgctcatgttggtggctattgaatcatagaaacatttttaaaagagcagtgctatatagaaaataaatgtgtatgtattttctgaggagagccatgtcctataagaaaaaaagtagctgtgcatcctgatgcatgactttaaagtattagttaatgatggtgaaagccagcgactgtggactgtctccctgcagttacccataatctgtccttgaaatacgcttttatcatatgttgaattttctttttagttttctctgttttttctttttaaatttttttcattattattattattattattattattatttggaggcggaattttgctcttgtcgcccaggctggagtgcagccttagctcattgcaacctccacctcccgggttcaggcgattcttctgcctcagcctcctgagtagctgggactacaggggcatgccaccatgcctggctaattttttgtatttttagcagagacggggtttcaccatgttggccaggctggtctcgaactcctgacctcaggtgatccacccacctgggcctcccaaagtgctgggattacaggtgtgagccactgtgcccaggcttttccccattattttaagttgtccgcattcttttgttttacaatttgctgtgctatatatttccttttcccatcatttccaatactgggggtataaattttgtagagaccttgagagggctctgatttgttttatgtatttttttttcaaatttgactgcacaaaagagcattatcataacgttgactgtttacgcattgtgcatgtttgtaaaaacatggaaaattcctccataaataaagagatgtcttttttgcatatctgcatttgtgaaagataaaatttctcgaggtctcggccatttgggtggctgcatatacagtgatgatccagtgcagtttttgatcaatttcaacagaagactcaggttgtccgtcatggtatttcagatgaccacagttacaaagctgggtgcacacaattaccaaccacagcaatgtgcatgcatacattccccttgttgacctgttacctgtttctttctgaatacagtttgctcatagctcttattcttgtgtgactgtcattagtatacctgaatgtttatccttgcaaaaaatgtatgttattattgttcattttattgcacaaagtgacctatgaagtgttcggtcacgtttttatgtttgccaaataaatctctttttgtacatgtaaataaatgtcttttaaggaattaaaacattttcctcagaataatagttttggaataattttgatctttcaggattgtgatttgggggacttttagacttcagggattttgatcttttgggatttctgcatttggatgtggtgtttgggattgtgtcttttgggatgataaccggctcctggcaaccactgatctgtttctgacttttccgtttttgcctttctcagtaggcaatatcattaggatcatacggcacgtagccatctgggtgtttaacttagcagaaagcatttaagatctatttatgctgttgtgtgaatcaacagttcattccttttaacgctgagtagtgaagtatttcattgtctggaatgtatcacaatttgttgaactcttcatctgttgaagaatgttttggttgttgggatggttatgaattaagctgctatgagcatttgcctacatgtaattttttgggaacttacattttcaattcacttgagttagatacgtaggagtgggtcagataagtatgtgtgtaatttttatgtaaagatttgtaaatattttgtgaatctgtaacagaatgagtagcactttttccaggtgagcgtgtggattgccaagttgcatagagctttttaagttgactgatttttttctaatttcattgaaaaatccagtagttttttttttatcaagccccccctccttttttttttttttttttttgctcttgctgatgatctatttagttattaggtggcaactcatgtcaacaagtgaattcacatgccatttcatcttttcttgccttaacacggtgaaaccccatctctactaaaaatacaaaaacttagccaggcgtggtggtgggcacctgtagtcccagttactcggaaggctgaggcaggagaatggcctgaacccgggaggcggagcttgcagtgagccgagatcatgccactgcactccagcctgggcgacagagtgagactccatctcaaaaaaaaaaaaaataataataataggcctaatcattgtacaaggatgaaggtagggaaaaaaagaaataggaagaagcaaaggcagaaaacatctaggatgctggagcgcagagaacacaggaatgactcaggagttttgatacaagtttgattagagaaaatatgcaagtactgcagtgactaagtagcagattatagttatgaaatcatgcaggacaggaacgctgaggttaaatacaaactgacaacaaaaatcataagaataatatgtaaaagcaagtatgaagcctttgtatttgcttgcgacttgcagtttgaatagcaaaatgatctttcacatcaggctcagtgtgttaaatccagccttaggcaagaataagcaaatattgtttccatatgacaagcctttagctgctagtgaaatgctttctttgtagtgaactgtaggcacaaactatcagcagatgactgtgtatctgagcatatctttaaccacagttagctacaaattatttatagaggttaaataaatgtttacactgaatgattcaggaatgagcacataacagcggtttgggggattatatttctgctattgaaatctaaatactcctacaacaatcctttcagcttagatccgtggtttctagttgaggaagcagtacctcctatgggacattctgggtctcctatgggacgtactgggtgttctgtgggcatttttggtggtcctgatgatggcatttgtggagaggacagaaaacagactgcacctgctgcagcgcttggatagtcctgcaggatgaagggcggctctgcgccctcatagatctcctgcacgaccctctagatgtttacgtaggtaaaagcaaaaaacaacaacaaaaaactagtacttcatttttcttaaacatgcatggtatttttgtggtatttttaactttcaccgatacttgctgcaaatgcaattactgagtaaattgagggaaaattgtgctttggttggttgggtacttttagcgatagccattctccatttcagcaatgcccttgtggtgtttgagcggccagtgcaacacctgtgaatcagtcttcatttgtagctgtggcatgcaaatatttaacagaggggatgtaacattcactgtaatagacttaaaaccaaatatgttttaattagatgaagaccatgaagtgtgaagagaccactgacttttactaatagtttttaaaaaatcactgtcatttatgtagtttttgtttccgtagtatgacagtatgaatatgttataaaatcacacatttaaatgattgatttttgaggttgcctacaggtttttagtcttatgctgatgtgtgcacaagtctacaacataactgtgttctagcctcctggttctttccctcttaagcatcagagactggatcttttgcttggcacgtgataggaattcaagataggagagtaattttctgggatcctttttcagtaccctatcctgtgtcaacataggacattattttgacacttcacttaaaaataagcctccttattcctgagaaagccataaatttctttttctttaataatgagtaatttgtcttggataaactgtctttaataaatttttttgtcttgtcatttacaaataagcatagtcttattttttctaatcttagtacttttgattgtttaatatttcagtttttaaaatcaaggcataacttacatgtagcaaaatacagaagtcttaagcatacaactcgatcatttttttcaacattttattataaacattttcatacgtacagaaaagccaaaagaattgtaaagtgaacatccatatactcaccacctagattctgcaacgaacattttgctatatttacttcatcgcatctatacatcttcatgtccctccattcttccaccagtccatcttatttgatacatttcaaagctgcaggcatcagtacacgttgcccctaaacacttcaccatgcatatcattagagtttcatgtgtttacttgttaagctaaaatttgcacacaataaaatggataaatattaaacataaaatattgaacataaaacacatatttttattattcctttcacatgagattcatagatgccagaataacagttacctttttaggggtggtggtaagaatgcaaatattttatatctctatctaggtggtgttttcatgagtgtatagtttaaaattcattcatgacatattcatacattagaatagtatttactgataataagcaacaaactaacatataaatgctcctcacatgattttacgaatgtatgcatccgtgtcctataagtccattaaggtatgaaatatcactgccactgttacctcagacagttctctcatgccccttcccagtcaaacctaaccctaacccaaaaggaaaccacaattttgaaaatttttgccatagaaaatacagccttggtatggggatttgtggatggtctggaaacccttcaggggaccctgggggtcaaagctatgagtagtattgttataatactcgtatttttataattctactttggcattttcccttttctatctcattctgttgtgaatggggattttcagatgctacagtaatttcttgcattgtaatatttttgctcctaggttctgtatttaagggagattgatgagctgaggaaagaatgaatgctttaaaacttgatctaaggcggtattctccatcctactggacaaaataccccccttttttacaacaaatatttaatcatggccctattattctcctgcgatgcaattcatagattaaaataaccatcctaggccgggcacagtgactcatgcctgtaatcccaacactttgggaggccgaggcgggtggatcacctgagctcaggagttcgagaccagcctgaccaacatggtgaaatcccgcctctactaataatacaaaaattagctgggcatggtggcccttgtaatcccagctaattgggaggctgaggcaagagaattgctggaatccgagaagcagaggttgcagcgagcagggattgcgccaccgcactctagcctgggcgacagagtgagactctgtctcaaaaaataaaaaaatctaaaaaaaaataatcatcctaaacatacaatttaaaaaaaatcaatataatattctagctttgatataaaggagacataaaagtaattcataatgaatatgtattttaatatgtaaattgaattcagaaacagataggaaaatccagctgtcttttattaagctaaacattaaaggcatttttaaaaataaaaagtgccatacttttactttgttttggaaagtattatttttcataaaacatgttatatagtctaatatgtaaggtttattgtcatttttaatgaattatgaatctcaagtatctcagtataaaatgtaatatggtaagtgtacatatataacaacataaaacaaaactttttggttttcttttaataattatagtttttaaactgtataaggatactgagagcaaaaaatttgagaatcactggtttagcttgtactagaacaatataagtgaattatatagtgtgtggctttaaaaaaaaatctagtgcttattttactcaggataatgtttctgagatgcatccatatattagtagtttgttccttattatcaataaacagtattccattgtatgaatataccaccaatgaattttaaaatatatgcccatgaaaataccatccagatagggaaatacagtatttgcatccttaccaccttgcccctaaaggtgactgttattctccatctaagaatctcacatgcaaggaaacagagtttgttcttttatgtctgacttccttggctcaacgttatgcttgtaagattcacctgcgctgtggtgaatggtttgttttctttccttttaacgctagttctcgttgtagtgtccacctgtatctgtgctcttttgttctcctgtattttcacatggaatagcttttaatcttctactatttctacatccagacatactcattatacgaaggtggaagtatctaacaacttcattatgctttcagtgtagtcagccatcagaatttacatattgaaatgcaaagtcattatgaattgccttctttggtttctcctttacatcactgttagggcattatattgattttttttaaaaattctatgtaaaaggctggctgttttatctggattctatttcaggggattaaaggaggcattattaaatattagctgttaaaaagcaagggaatattgagtccagcaggattcagactacctccttagatcatgttttagagtatttattcccttctgatgtcaccatcctccatgagatacagaacctaggagcaataacattgtaatacaaagaattgatcacttgcttcacaagaacatgcttttaataagtgtatcatttattttacaaatggcgttttcccaagagatgacatttctggccggttgaccaaaatttttggtgatgagtagaaacttcatgtttgaggattgacatcttgaattttttgtgcaaaatttgaatattaatttatagaggacattattcttatctccacagtatctcatttgcattagttaatattaaataagtaaagtagttgtccatttttctcagtcttaacactttctaaattcatgcctcaagaagttcttttattccaagaaaatgatccaaacgttattaattgcaaagtgtactcacttatttttcacttcggggaaaaaagcagaatgataactaaaaatgaggtctctgaagttagactaccttgatttttaatccagctcccctacaccagtcacttccttgtatgcctcagttttcttatctagcaaatggggtaattgtacctacttaatactactaagtgtacctggttaatatggtttttgtagttattagagggaataatataacgtgagatacttagagcagtacttttagtaaggatttagtaaataagctttagtaaggacatgcaagatctgtaaagaatagcttttggttattatgggctattatgacttcagaaataataaatataaagctaatattaatactagctgttacaactttagaaataggaacaaatgatgagattagggcttgttcctttgaattttttggaattagttttcttagcagtcaacaagtatatatggactattagatgtggatactttggaattaaagatataaatgagtaattaatactccttagagtgagctcatggcattgtcactttaacaatatgcccaaaagtggttctatttaaattccacacaagagaagtagcaatgttatatagagcattgggttttcgtagctatttggatttggaaattaggagcatattagtaatcttagtaggacaagccagaggaatgaagagctaggaaggaagtagggattgtgtatccagctgggagaagtttgaatgagcatggaatagaatgggcatcttggaggagatccttctctaaggcatctagaggagaaggcagtgaacttcacacactggagggctgactcctggaggtgactatggagggaggggtgggccctcaggtagagtcagaagaccactcgtggctgcagagggacacttggactctgggactgcctttggtgagttgacccagggactaaggggagaaagtttgaaattgtgtctaaggggattgagcaaagcagcctgggaatgtgtaaaaaagaacacacaaataaacaaaaaagtgccgagtggtcctgaaagcccacgggatgagacagtttacagtgtgagaacatggtaaggcttttaaaaaaattgttttttctctttcatatttttcttgtaattgcttattttaacacaaaatgaaattcatgatagctaacacttacataggcttactctatgccaggcactgatctggtgtaaatactttacatgtgccagctcattccattctcccactaattttcagagctaggtaatatccttctcatcactttacagatgaagaaacagaagcactgagacatgaggtaatgtagttaggaggggaaaatagaatctgaacccaggctgtctgaatcccaagtctgtgttcttaattatctaatgatggtattttgcctcaaaaaacaaacaaacaaaaaacaacttaggaatcatttggaaggaaacaaaaaaaatagcacaacaaagtattatgcaggtcattgattatcataaaatgactgtctcccaaagcaaggagagatgattattgaacacttactttgagccagttactatcttaagccatttactttaccatccccattttaatcctcataactctaatacgtaggtgctgttactttcatccctgttcacacatgtggaaagcagcagggcattaatctttctaaggccacacagccaataagaggcaaaagcatggcacaatcccaggctcttgattgtcttagggatggtcattaacgtgccatttattattctggttggtagtttagcaaccagctttctaattgcatttactattctctttaaagcagcgttgaatataatagactgcaaccatacttctcctctaccacctaagttgcaacagaaaaactgttgctttgaaggatgtgcaagagcatagacatggcccgcataaagcagagtgtgaaggtccccaaaactcaaggacagtattgtcatggataaatacagccgattgagcatgctgatgaaatgttgcattatcatcttgaaccttaaactttaaggaaaataaataaaaatcagtaacttcaaagagcatttcattaaatagacaagtctttattattaagccctcagcatttctcagctcagcagcagttcctgagactgtgtctgataatctgaatggatagtgcaggcatgtgctttacatttggaatgtcttagaattgcttcttggaagctccagtgccaccagctgactggaataaattacacgcctagtctcacatattgtcagaagttttcacgtgtgcatcgggtacagcctaaaggtttggcacagagctgtaggtacacgtttatgctcaacactgagaaattgaccagaaatagtcaccaatgcttcacactttctgaaactcccacgtgtattcctctgaagtccctttctcattctaccctctccatgacccaaattgtcattttccattcagttttccttccccactcctttagatcctgtttggtagacttgccgtaggaacacagaacaaaatgaaacattttcttatgaatattcgtaaatttctgatggtcttgccctgttaagaccaaaatctataggtgtgccgggtgacatctgtaaaatggttgtaattatgccacgttctcttggtgccctaaaacctttgttgaattttttacagtagagctttttaaataagactttttatttggaaacaattattgaattgcatgcacttttaagaagtaatacagagagatcccatggacccctttacctagtttcccacaatggtgattgtctttgtccatttcctgttgcttagaatacctgaagctgggtaatgtatgaagaaaaagaatgtatttcttaacagctgtggaggctgaaaggtccaagatcaagggtctgcatttggttagagcccttttgttggtggggactctcttcagagtcctgaggtgtagtacagggcagtatatagtgagggggactgagcctggaacctcaggtctctcttcttacaaagccacaagtcccactcctatgataaccctttaatccatccactcattaatatattaatccatggatagattaatccactcatgaggtcagagtccttatgatccaattgcccctaagctcccatctctcaatactatcacattgggtattaattaaatttcaatatgactttcggagggggcacatattcaagccatagcggtgacatcttgcagaattgcactggaatatcaggaccaggatatggacattgataaaatctaccatgtcagtgggactcctgttcaactcagatgagggatgagcctgcctggactgccttctatggtaggttaggggttaggagttaccaggcctggcttactttctgctgttggtgagggaaggaaggtaacgttctttgttgcgatcttcctccagtcctggggtccctagccagttttcctgcttgttcacaataggtactaattgatgctcagctgaaagtcaaacactcagattttctcagtgttatttgtacttattgtctgtgtgtgtgtgtgtgtgtgtgtgtgtgtgtgtatttacggctatgtaattttaccacatgtgtaagttcacatatccctactacagtctccattcatggagaataggttactggttatgaggagtgagggagatgagacagggccgaaagtggtgaatgtatttataaaagggcaacagaagggatccttgcggtgatggaactgttctgtatctggactgtatccgtttctataattatgtcatttcaagaatattctctaaatggagtcatacaatatgtaaccatttgagattatttttccctctcagtgtaattcccttaaagtccatacaaatggctatacgtattaataactcattcatttgtattgctaagtaatgggtcatggtatggatgtaccacagtttgtttcgccattcacctattgaaggacacctgggatatttacagttttgggcttctgtgaacattcatgcacaggtttttacataaacataagttttcatttatctgagataaaaatctcagagtatagttgctgcgttgtgtggtagctatatgtttagtttcctaagaaattgtaaaattgctttccagagtgcctgtagcattttacattctcaccagcaacgtctgagtggagtagagaggcttcccagcctgggcacttgttgtggagagattcccccttgctgtggctgcccagctgccttgtgtgtgttggtgagaaaggagtctcatgtctagtggggaaggaacatccttctgtctcctgattctcagtgggctgccagttggttgatcccttgcctgtgctgccaggcttaccttctgttgtcagtgggactcctgttcagctcaggtaagggatgagcctgcctggactgccttctatgataggttaggggttaggagttacgaggcctggcttagtttcttctgttggtgagggaaggaaggtaacattctttgttgccatcttcctccagtcctggggtccctagccagttttcctgcttattcacaataggcaggtattgttgctcatgagcctctgaattggctgggtgttttttctggtcttggctttgtttgtcccttgcactaattgatgctcagctgaaagtcaaataggtggctctgctgatctggactgagctgcctcacatgtttggagatcaactggctatgggctcatctagcatggcctcagcttgcacagtcatgctcttctctctgtggtctctgattcttcagcaagcccacctgggcttgtgcacatgatggttgcagggatccaggatagtgtggaagtgcacaagccctcttggaattggagcttggagttggcaagccatcacctcacttgcgtcgagtgaaccaaagcaagtcacaggatcagcccagagtcaagaggagaggaaaggacgtgcttcctgaaggcaggaatttcacattcatattgcaaagagcagaggtacaggggagcataaagaatcgaggccgtttttataataaacttaactcaccctcattgttgtgcatatgtatgactgagttcatctcttggggttctgaatacctttaacctgtctgtactttggttacagggactgacatctgagtcatttctctttgattcataggatggatttaatttttgaagccatccatcatggaaagaatatgctttgtcttctcagaaattgttatttttttccagattatttcttgacatgtttctgcatttttcaaatgtccttttaaaagtatgtagctttgttttccaatttttttttactgtggtaaaatacagataatcaaaaatttactgtcttaaccatatttgaatgtatacttcactgccattgagtacgttcatattgttgtacaaccatcaccccccatccatctccagaactcttttcatcttgcagaactgaaatgctaatccattaaacaataactcctaattcccttcttccttgagcccttggctggcacccttctactttttgtcttatgagtttgtctactccgtgtacttcatataaatgggatcatacagtatttctcattttgtgactggcttctttcacctaatgtaatgtcctcaaaatttgtttgtactgaagcctgtgtcagactttccttcctttttatggctgactgataaagagggacctgcttccgtcatgttgctattctttttcctatatgtcttatcacttttttggttttccatttcctgcatttgtctgcttttgtgtttagttgattttgtgtagtgacatgtttgaatttttttcttttttttttatattctacgtctgtttttcttgtagttactatgcagatgacatttggtatcctaaagtcaaatactcttaatttggatttatatcagctgaacttcaatattatacaaagtgctgctcttttatatcttcattcccactgttttcagttgttgatgtcacaaaatcacatacacgatacttccaaaaacatcaataatttttaaaaatgcattagccttttaaataacatagaaatcaaaatgtggggttaaaaaccaaagttacaatgatactagcttttagactaataattgcttttaaaaaaagtattagcatcttaaatcatatagaaaaaagtggagttacaaactagtgctaaaataatactagcttttacaattgcttatgtatttacctttactgaaatctttatttcttcatacagctccaagttactatccagtatcttttcatttcattcagaagggctccttttagcattttttgcagagcagtctacaggtaacaaactccctcaacttttgtttatctgggaaatcttaattccaccctcacatctgaagtcccattttcctagctgtaggattcttggttacagggttttgtttttgttttttcaaattttctgataacaaatctgctgataattttattgaggatcccatgtatcgtgatgaatcactgcagtttcactgatttcaagattctgtctttgtatttggctgtgggaagtttaattacaacgtgtctcaatgtggatatcttaaagttcttcctacttagagattgttaaacttcttagatgtttgtattcacatctttcctcaaatttgggaagttttcagcccttatttcttcaagtatactttctgttctttctccctctcttctttttctaggactcccataacacatatgtttgtcctctttattgtgtccctcaagtcccttttgctctgttcacttttcttcaatcttttttctttctattcctgagaatattttcctttgccctatcttcacattcactgattctttcttccacctcattaaaattgcttttgaatccctctagtaaatttatcacttcagtttttttttctgctccagaatttctttttggtttcttttttggttttctgtctttatttatatttccattttgttcaaacgttgttttcttggctttctccacatctgcctttatttctttgagcatcttcaagacagttgttttaaagtctctgtccagtatattagccatcagggctttttcagggacagttactgttgttttattttttttctttaaatgagtgatactttcttatttctttgtatgccttgtgattttttgttgttgttggaaagtggacttttgaatctaatgaggtaatatggaaatcagatttcccccttacccaaagtttgctgtttttgttttttgttttgctggttgttgtaggctgtttctgtgccatggatcagcctaaggtgtatacttaagttcttctcaggtcttttctgagcctctgccttttgctgggcatgcacaggcacttcctaattttcctcatatatgcagttgcttttgaatatcctaatcttcaatgtctgcttcctaaaagaagagaaagagaaaaattaggggataaaagaatactggcctttggccaggcacggtggctcatgcctgtaatcccagcactttgggaggccaaggtgggtggatcacgaggtcaggagatcgagatcatcctggctaacatggtgaaaccctgtctctactaaaaatacaaaaaaattagccaggcatggtggcgggtgcctgtagtcctagttacttgggaggctgaggcaggagaatggcgtgaacccaggaggcggaggttgcagtgagccaagatagcgccactgcactccagcctgggcgacagagcgagactccatctcaaaaaaaaaaaaaaaaaaagaatactggccttttaaatctcatggaagtcactttaggtggttggtagaggcctacaacagtgggggaaggtgcagcaacagcggccactggcctctttgtctgcacctctgtgatcaaaagcagcaatcagtgataagaacagatgtcttgtgtttggaggacagtgtcctttttgcctaccaaggctcctgcaaaccgtatgccaagctgctccaggaacatgtgcacagctgcctgccatgggactggggcatgggataggtagctctattatgccaagagctgaaattaactgaaaataacttcaatttactgtccaagccttcttctggaagttggaagccttaagtagcctccagagttccaaaatagttatactggacagattctgccagtgcaattgttgtccaggtgagaatacagactcctggttctctctcctctgccatcttcccagaatcatcctctgtatcatttttataatctgaaaaaaatagttgtggaatttggaggtatttttctaggttttatgatcttctcctgaatgttactctttgtccagccttataaatttttggtattattatccagacaaccatgatcctacaagtctgacaaaccatgctgtgactacttctaattgggactgttaaattatcacactcatgcattcctgtgagggaagccttttgcttctatggtgggtcctctgtggaaggtgcgtctgccggggacctgtgaaggctgggcagtgccccagggaactgtgaaggctggacagtgctcggcgctgatcgatggcagggtcagctttttgagagccctgtttgtgttgtcccactcctgttcctggagaaaatcacctttacaaaggctcaactggcaattttggaattacttgggtcattgttctgaatgtgctattggttttcagtaaataaagttcaaattagaagcttagaaatagtttaaggtgtttggtttttgagctcctaatagtctttcttcactattttggccctcttggtttctattaagttggaccatatgtaattgtcattttgtaagtcaaaagcaatggaatagtggcaactgcctatggttcaacctaatactttacattttacctgtagcagattgtggctttgttttgttgccttctcaactttcaaagaaagcctttttttttattttatttttttttttctatttgaaggctgtttcccagaccagatgtatctccagctctgacacatatgtgcttgactggtcattcacactgatgtttctaaatcagcctttcataacatttttatttattagtacctctttttttttcttttttttttttgagacagagtcttgctctgtcgcccaggccggactgcggactgcagtggcgtaatctcggctcactccaagctctgcttcccgggttcacgccattctcctgcctcagcctcccgagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcctagtacctctttaaatgaaaaaattatttgataaagtcttgactgtctttcccacagttgtttgtgaccagtatttgcactgattctcgaaacgagtgaatcttccaccagtccctaactgtgatcctaatcacgtgtaacgtatttcccaccctgcattgtccacaggattcttcattcatcacctaccacgcatcaaagtgccagacactggagtcagaaatatgatagcaactcatgtatgctgtgtgatcagtaactatctgttgaatgaatacatgactgagtgtaagttaatgaacgaatgagtagcatttgctttggaggagctgtctgtcttcagaagagagaaacttgtaagcagacattgtcaatttggtgtgcaaaggacaatcatagatgtgtatgcaaagggccatgggaacactgcagagatgttagtttttcatatgcactgtacccacattctgtttcccagttgcacggtgaaaatctattctgtcagatttgtgttttgatcacttaaggcttctgttactatcacctgaacaaattatgcagatttctcaatcacatttgacatttctggttcaatattatgaacccgatcagatcccattgttgtgtaacattttctggatatatgtcttcgtcacctatctcacaggtttgttgtgaggcgtaaatgaagatagtatgtgaatatgtataaaccactatgcagaaaacatggaggttaagctgtcactctggatgatagttgttcatcactgcctacagtaactgacctataaaacaaccactaggaaaaagaaaagaagatattttgctttttttttttttctggaagaaatacagtagatactcaaattgcctgccaatagaatagtttcctggacaaggatgaatctagaaaggacatttaacagagattgaccttggttttgttacagtgacctgagaatgtcagtcagtagtcttgcataaccaccatatagtgaaacttctcaaaatctccatggtaacatgcagagaactgtatcatagagcacggtgtatacccacacggactgtgatccaggaagaaagatctgtttccacccccacacacacttgctcacgttcacctctcttctgccccagcgcctcagatacctgcttcctcactggtaattgtgatgatatttttctctaaaatctattttgtaactcattctttctgattttactctcaacccccttggcgcttacattggatgagataaaagtgtcactgtagggctgtaaactttgttgtgatgaagactcttgagacgtaaaatgtatgctctaactgcagacctgtgcagaacgcgagtttgatcttcaagtgactttcgttccagccttgatattcagatgcagtgcactaatttgcccttattggcatcctgtttaatagatattcctaagcctttttccaaatagttgcatgtttgaggaagactttatggctatcaaagtgtttactcatataatccagtttgatcctcaccttgtgagatcgtcagggccggtaggatggttgtcattttacagatgaggagacattttctgatgggaattagccaacctgtggctgagctggaaccagaacccaggcctgtgtccttgtactcaggttgccacagcattcctcctgatgtgcccagcagcaggcttctaaaggacctgagccccctctgccaacagtgtcccctcttagctactggtgtgatatgtagctgtgagtccagggtgggtattcacatattttcgattgaccaccagcttaaaacttcccatgccacaccacactgcccatctatatattactttgcaatcattatcataagcttaaaacttcccatgccacaccacactgcacatgtatatattactttgcaatcattatcataagcttagagactttacagaaagtcgtccttaaagtgttgctaaaaaatataggtcaattacaaaaggagacatggtccttttcttttttcttctcccctaattataaacaataaaagccacagcttcatgctgagaaaggatcagcagggaatgatggacattgtgatttggcagctgacattttctaacatgattttgttttacataagtagtttgaagtttttgttggttattgtcttgccttcctttctgacaaagtaacattttttttgcccataaaaatcaagtagagcaatgcatttcccatgccgtcgtgtctcccatcttgtagcaaccagtagtgtataaaatgaaagtcttcccacctttaagcaaatgtttgttttccttattaagaaagaagtttcatttgaagctggaggtttttttttcctaacttatattagtccatattttaatagtagtttcctaaagaaaatatctcagcatgaaaaagcaaggtgatactatattttagaaaatgccctcatggcttagattttaaaactaatgcttttgttaagtgttttggctttgaacaaaaagcctccttgagaaacgctatttcccattgcacggtttcttaactctctgggttaaagttcgtattttctatctttttacatctggcaaatagacccagagaatgtttttgtttcatctaacagttatttctacagatctgaccaggctgcctgcacacatctatatttttacactgacagcataagtgtatgttttgtatttcattgtagcgaaagcacttcacgtatgcttatagtaggttgaagtatttttagatcaaacgtgaatccaccatgttccgtaaactaaaatatatttaatcttaacagagtatacttggcggaatggctgactttaaacataagcttaaacaaaatgatgagttcataattatttaatgtaaactgaataaggttgaagggccctgcagggtcgatttcaaagtgcttcaatgattacaaattatagaccgcctttccagtaaaacactactcaggtgggagactagctggcagcactataaagtacctaaatggtttcagactaaagaatctgttagttttgtaggtttaacatccttgacacttaataggatttgagattccattgtagcagcagcttttattgcatgacactttaattgaatgccttagagtaaaatgaaattaacaaaggcagtattaaattatggatgttccttttttatcatttggctaagaattctgcggagtttcttttctgattatattattttaaattgattgatgtgaaaaaataaacacactatctttaggactaggtataccatctggtccaagaaattgtgaataaaatgaatacagagctggagttggccaacttgtctctcctacgcttcagaaagcaattacgttagggctagagtagtttaaaaatggcctgcaataaatccccattcttgagtggataagagcaaggcagctccgtcttttgcattgtagctaccagaatgacaacgtattctgagacagatgggagacatcgaacagtagttgatttttgtttgtgaagtggtgtggcaaagccagtaacctattttttttaaaaaaaaaaaacaaggacaaatttaaccaaatctgacctgtttatatttaaacatcggtgattggaaaaccgttttcatatttggatattgacgatctttatattgcttctccttttctctaatactatttaaaataagaatctgcaactaaactaaaatattcaaaaaataataaagttaagatgatgagtccgggcgcggtggctcacgcctgtaatcccagcactttgggaggccgaggcgggtggatcatgaggtcaggagatcgagaccatcctggctaacaaggtgaaaccccgtctctactggaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagggagactccgtctcaaaaaaaaaaaaaaaaaaaaaaagatgatgagcatgatgtcagcaagatagtggaatcagaagcctcagtctctactcccctgacccccacacaccaaaaggtgaacttgcagctgtccacagactagaatatctttttgaaaatgtcaacacttggaaacgagcctgagatacctgtgtgatctgcataattcaatgaaatctgaattaggagagtgagaagaatggtctcactctgaccacactgccccttcccatctcccaagttggcacagtgccagactgagaggatttccctggaccaacagtttctgccacagggaaagagaaccagaggcagtcatctagtgatgctaacgttccaggatgcttcacaagaagcccactctggtctcacctcttaggaaacactaggagaaacagcatggccacagtgcctagggtcaggtagaaacaaagaaaggaggcagaggtcatggttaccagcacatggatcttagaggtacctctgtgtttctggcagctgtggctcccaatagcagataccagtcaacttcataacccacatttaaagctaagctggttgccttcattaacgtggtaggaatttctacctagcctgagttcctagaatgctattctccctggctagcttcagagcccacccaacaagcctgcacaggcaggaagacattcacctcctcccatttcagggaagcaaaggggctagatcagcttgacccagaaagtcgagctgtggctccacctagctagaaagcccacccaaccaccctgtgcaggcagagactcccacctcctggcattttggataaatgcaggggctagtcttgcttgatctagaaagtcaagcagcagcactactcagccaaaaagcctgcccaatgaccccaccctagccaggagactcccagctccacagatttcagagaaatgaaggggttagatcagctttacctaggaaggcaagcagtagttccactcagcccaaaagcccacccagtgacccgacgtaagcagggagactcccaccttcatggatttcagaaaagcatagaggctagacctgcctgaccaggaggtcaaacagtcactcaactcagtcaaaagcccacctcatagctccaccctgacagggaggaaatcctgaatcatgaatttcctaaggaacatagcctctggtctgcttgtcccaagcaatgactttgctaacctcagagaacagcctatagccctgcccaactgtagatctcaatagtggccaaggaatacatcctgtaactggcctgaccagaagtcattgcagtacttagccagcaatctcatcaaacagggaagccaggcccacaaccccacctgacatcagagcaaaagcagcagcccaactaagttgtgaactctcatgaagctctgcctgcccaggattatcaccagatggcccttccagaatcacagtctagattagatagtggaaatctattcctgtcaaagaacacctgtaaaggccagaaaaggggactgtcttctcaaatgtgcagataacacaaggattacaatgactcaagggaatcatgacacctgcaaagaaaactaataaagcttcaatagtagaccccaaagaaatggagatctgtaaaactgttgacaaagaattcagaatagtactcataaagaagttcagtgaactacaagaatctatggatagaaaattgaataaaatttggaaaacagtacacaaagaaagcaagaaatttgaccaaaaatagaaacaataaaaaaaaacaaatcttagagatgaaaaatacagtggctgagttgaaaaattcaatagaaagcttcagcagaagacactgtcgagcagaagaaagaattagtgatctggaagacagaacatttgaaataatccagaagagcaaaaagataaaagaatgataaagaatgaagaaagcctatgagagttatgaacactgtcaagagatgacacctttgtataatgtgaattaaggacagcagagagaaaaaagcaccagaaactatatttaaagaaataatagctgaaaacttttctaatataggaacagatgccaatacccatgttttaggctgttgttgcattgctgtaaaggaatacccaagactgggtaatttatgaggaaaagatgtttcatgggctcatggttctgcagacagtacaggaagcatggtgccagcatgtgcttctggtgagggcctcaggaagcttacaatcctggcagaaggcaaaggggaagcacttgtctcacatcgctagagcaggaacaagaggtgatgggaaaaggtctccaactccttctaacaaccagatcttgtgtgaactcattaccatggggagagcagcaagccactcatgagggatctgtccccatgacccacacacctcccatcaggcctcacctccaagaacgtggatcacagtttaccgtgagattgagaggataaatgtgaaatcatatcaacccaagtacaggaagcagagttctccaatcaaattcaacccatagaagagtttaccaaggcacatagtaatacaattatcaaaaatcaaagacaaaaattccgagagcagcaagagataagaaacacttcgtatacaaaggagtaccaatactaccatcagtggatttctcagcagaagccatgcagacactgaaagaacaagatggtatattcaaagtgctgaatttatatttatattttacaataaagtgttgaatatgtaacgcaagggtatcatactgcatattagtagttgagaaaaatattaaaattcaaaatttgaatttaatatgtattgcttttgcattattgtaaagttgaaaaattctaagttgaacttttataagtcaggaattgtctgtacttccaaaaatctttttacaaagccaacattaccttggtaccaaagccaaacaagaacattataagaaagagagttaaaggtcagtgttcttgatgaacatagatgcagatttctcaacaaaatactaacaaactgaattcaacaacacattaaagggatcattcatcatgatcaagtgggatttattcttcgatacaaggatggttcaccatacacaaatcaataaatgtgatatatcacattaatggaatgaaggacaaaagccatgtgctcattttgttagatgccgaaaaagcatttgacaaaaattcatctttttataaaaattctcggcaaattagttgtagaaggagtggacttcaacacaacaaaggccgtgtgagagaatcccacaattaaaattatactcagtggtgaaaaattgaaagcctttcctctgacatagacaaacatgcctattcttgccacttatatttaacatagcattggaagtcctcaccagagtagttaggcaagaaaaataaatagaaggcatcgtaataggaaaggaagagctgaagttgtcactgtttgctgataacatgatcttatatatatagaaaatgctacagaccccaccaaaaaaaaaaaaccctgttggaactaataaacgaatatattacagttgcaggatacaaaatcaacacacaaaaatcagtggcatttctatatgcaaacaatgaactatctaaaaggttatcaagggaacaatttcatttacaacagctacgaaaattacttaggaataagttcaaacaaaggagtgaagacctttacactgaaaactagaaaatgttgataaaaaagttgaagatacaaataaatggaaaaatattttatgttgatggattggaagaattaatattgttaaatggccatactaccaaaaccaaccctaccaattcagtgcagttcttatcaaaactacatcatttttcataggaatagaagaaacaattctaaaatttatgtagaaacaaaaatacccccaaatagccaaggcaatcatgagcaaaagaataaagctgaaggcatcacactacctggtttcaaactatactacagagctatagtaattaaaacagcatgggactggctgaaacagatcaacagatgaaacagactagagaccccagaaatgaacccatgcatatgatttaaatttattttctttttcttttttcttttctttgttttttttttttggttagagaaagggtctccctatattgcccaggctagtctcaaactcctggcctgaaatgactcatccctgagcctgtcaaagtgttggtattacaggcatgacccccatgcctggcctattcaactgattttcaacaaagatattatgccaagaatatgcaataagaaaaggatatccccttcaataaatgactttgggaaaagtagatatccatacacaaaagaatgaagttagattcttacttcacaccatatattaatataaaaatcaactcaaaatggattaaagtcttaaatataagatgagaaactataaaactaatctacagagtaagaaaaaatatttagaaaccatactttggataaggggttaatatccaaaatatataagaagctcaaacaactcaatagaaagaatacaaaaaattctaattaaaaaaatggacaagggactggaatagacatttctcaaaagaagacatacaaatggctgacagatacatgaagaaatggtcacatcagaaatcactaaggaaatgcaaattgaaatcacaatgagaaactacatctcacacctgtcagaatagctgttttcaaaaagacaatataacatgtgttggccaggatgtgaaggaaagggaaccctgttggtggaaatgtaaattagtgcagccattgtggaaaactatgtggagattcctcaaaaaaaatgagaaatagaactgccatatgatctggcaatcccacctctgggcatttaccgaaaagatttgaaatcagtgtgttgaagacgtgtgcacaccaatgtttactgcagcattattcacagtagctgagctgtggaatcagcctaagagtccatcagcagataactgggtaaagaaaacgtggtacttacacgtaatggaatactattcatccttaaaaatgaaggaaatgctttcatttgcagcagcatggatggaatcagagagcgttatcctcagtgaaagaagccaggcacagaaagacaaatatcacacaatctcactcatctgtgaatctgaaacaataactcatagcagcagagagtaaaataatggttatcgaggctggagggtggggggaatagggaggtgatggtccaagagttaaaagatctcaggcaagaggaattttttttttagttttgttgctgagcatggtgaatatagttaataatagagaattgtacacttcaaagtgtctgagagtaaattttaaaagttctcaccataagaatcattaaatatgtgagctgatggatatgttaacgagattgatttaattattccacattttattaatcaatcataacattactttgtaccccatacatttatgcaattgtgaattgtcaatttacaattaaaaagtattttcaaagattttaaaaagtggaggctggactgcttaggacatgtgaaaacagaagacaaaatataagaaaacattacaaattaaataattattttcttaacagactattggtgtaaatgctttataagtaactgtctactggatggaaagggggaagaaatttgaacatatctggtaaattacttagtaaatttaggcatttatttaaaaaaaaatacacttgctcatgattataagacttctgagctcagattgtgagtgtgaggaaagaggagacagcctcttaaaaaggtcccaagcatgacagatgcagatcttggttgagagttgttgcttctgctgtcagtcacatcatcatcctgttaaatgtgaatttatcttttttcccctatgcaaaatagtgagagaaatattccttgaggaaatgtggtctttatttcaaattaacagttttagcgattgcttgcttttattaggtcatgcatcttgttttctggatttgtcatataatgcagttgtgctcgtgtaggtaacacaaatgtggtctctttgaacatagaagctgggattgcagtgaaatagagagagcgaaagtgctctccttaagtcctccttgtttgttctctttcttttgggttctgtctgttaatttatctcttttactctttcccttcttccttccatccttgtcaaaagcatttatgtactggacagaagcatgtcttggatgacttaaagtgcagccctgttttgtagttattatcttcctgcataataagtaatctctgttttccacttgttgcagagttaaacacagctttctagtgaatcctcaccctagagtagaggaatacgtgatattaattgaaatagacttcctacagggcattttgtagcttttctcctctttctcacttaaaaaacataccagatagttttgtgttcaggaccttaaatcctagcctagcaacggtcatacattgtgaaacaaataatgagagagaaggttatagttaatactcttataagcctctccatgtacaagaatacagacaaaaatgcaaagaacagcactggatgtcttctgattaatcaaattatttctgtgtctcagtgaatggactgaaatacagtacagcctatttgccttaataccgatgaatttttatacagtgagtacgttctctggtctttttctcgctgatgaaatggatgtttgtgttagggctagagggagaaaagaggcgtgatttaactgttacctgtgcctgtgctttacagttttcctttttaaaacaagttttgaggaatacacctcggtagtactactgtacagctggcaccctacaactccctttggctcctgcagctcccccacacccccaccaacacactaatccatataaaagtcatattactggagctccacctcatctttttcagatatcaaagcaaatagaagaaatagagtataaacattgttctcttactctgacaagcagaattgatagacatctttccccatacactttagtggtggttgacataaacattgtttttgttttcaggttggaaataggaaatgagacttgacaatatattcgtgtcactaaaattctttattccagaaaagacttagtattgaaatcacacacacacacacacacacacacacacacacacacacactcccatacagaaaacttttctcagtggactattgccgttagtctttctcctttttcccacctaattacctgacattgtttgaaagataattataattgacaaaattattttttctatacataagcatctaaactctgattaactcaggaaaacacaaagaaaatagttacttcatttgcagaaaagcaaaggtgacagagcgtagcaacatgatgcagctgatcacactggagccttgtgcacacgctgtgttcctcccatttgagcttaccctagagatgaacctgtgtaaaaagaggtaaataccaacaggaactgagagcaattctagaaaaactaatggcattggttaaaaaaaaaatcccttctcctcaatttctgtgtctaagtgattcctaaagtaccattttataaatacgaagtatcattcctctggaagaccattcctttttgtttttttcagctggcccgagccctacctgtcctttccttataaaatactggccaggtcatcagaaaacagttaactcagagatgctctctaaaaaactctctgaagttgacctgcatggcagaagtgtagcaagtcaactctctctgctgtccctcacctgttctgtagctttgtgaagtcctgcatgaaagcatttcaacataagacgtggtttcattggggcccttctacctcaggaccgctggagtttgtatggctgtcagtgtcacatgcggttgcacagaagccactctcagaagtctgaagagaaaggaactgaataggagagttagtttcttagagagcccgtgggaggaccggagggcaggctcttggaagtgactctgagaatcatgccaaacagctcgtgtgctccggggagtggacagtctcaaagctgcagccccacctcccggcccgggacctcactccttctgcttcgattgaagcaggaagccactctgcactcactggctctgggagagagtgctcgggcaccagcttcttcagcagtgtccccgcctctcaacagtcatgggtggctactgctgccggacaccagacaccttcatacgcacgcttgtcagaacagcagaaacctggtctcaccttgtgtctccctccatcgcccataacagggtgtgcggtcagtgtgtgaaactccacaaggagtttgagaaatgcagtctcgtgctttctagcttctgccaggccggagagtctgtgcagaggggataaggtggggtagaacaagtctgtctgtgatatctaccacccagtctgcatttgaagtggaattatctcccgaaggcaaagaaatcacatgtcctattagaattctgcatgctgtgtgattctgatgccatgattcctataccttttggtcaggggtgtccaatcttttggcttccctgggccacgttggaaaaagaattgtcttgggccccacataaaatatactaacactaccgatggctgatgtgctaggaaaaaaatctcataatgttttaagtaagtttatgaatttgtgttgggctgtgttcaaagcagtccgcgggttgggcaagcttgctttaagtcatttgtgtggtgtgtcaagtagtgctacccaaaggtccctcaaaaagcatcattcgcccttgcctctcccagttccgagagaggagacagaattcagggctgagcctgtaggctgcgtgagtctcctgctcagtcctgagaagaagacctgggcatgggatgggatttagatgtagaatagaactgtttacgggggctcccctctgttccctgagcatgggttgtcattggttggcacaagtgccacggctgacaagctcctttctgagggagcagagcttgaccatatacaagatatgataatactgtttgtcaaggatacagcctgaaagaatgaaatagattgaccctagggaaggccactaaccggggaaagtaattccacttgtagctgcttttttttttggacggagtttcactcctgttacccaggctggagtgcagtggcatgatctcagctcaccgcaacctccacctcccaggttcaagcgattctcctgcctcagcctcccaagtagctgggattccaggcatgcgccaccacgcccggctaatttttgtgtttttagtagagatagggcttctccatgttggtcaggctggtctccaacccccgacctcaggtgatccactcgcctcagcctcccaaagtgctgggattacaggcgtgagccactctgcccagcctgtaactgcttttctactttacaggtataaataagtgttcctaagcaacccttcttaaaattagttattttaatgggactttttgtgttaggttattttagaaacattggtcacgtgtatatactttgggaattaaaaaagaaaagtggtgacaggttggaaaagtgtatcatccaacttctgatcaaacatggagcattaactctacacttatatcatctcttcctcctgaaaccccatgaagatgatagaaagacaagaagatcaagtgtgaggtacgagggaaaagggattggagaggaggcagcaggaggctgtagatgagatggcttgtgagacctttgcaggatagaaagcacttggagacacaggagctgaccagcggaacggggactgttgcagtcagagagcctgcagatcagtttacccgcgcaccctggacaggctcgaggacaggctgtgttggggggttgggggcgggtagggggcaagtggcaggagtggtgggaagtttacacacagcatggtcgccagctaactctgcaccatttcctgccaccacctctcccccttcccgaggaccaaatagttattcagcggagaagttgagaaagaccccgtagtccaaatgccaggtgtagcagagtgggaggtgaggacctgagaggagaagtctgcagactgaatggtggggccactatcctattttctgccgtccttcctcagacaccagcaactgatgtttatgtcacagtttagaagccagggggctgtctctgaagaaatggaatgggttcagagagaggactttcagatatttatatctgaaaacagaaattatactaggtatttcaacagagggatttaacacatggtaaagcccctctcccttttcccgccctccagtctcctgtggctgctcaatggcaggttctaacgaggagccagctggcaaaggggcctgcaaaaccagtctgcagagaatagtgtggaaaggtgggtttggagctgagaaatcagaagcgaatggcccacacagaggcaaataccagatcacatggttaaaaagtctaacagtcggccaggcgtggtggtcacacctgtaatcccagcactttgggaggctgaggtgggtggatcacttgaggtcgggagttcgagataaccctgaccaacatggtgaaaccccatctcactaaaaatacaaaattatctgggcatggtgacgcatgcctgtgatcccagctactcgggagactgaggcaggagaattgcttgaacccgggaggcagaggttacagtgagctgagatcatgctattgcctgggaaacaagagcgaaactgtcgccaaaaacacacacacaaaaccaagtctggtagtggttgcttttgggctgtggaacttggggctagggaggttgggacaggggaatattcattttgggggcagaagctaaagtgtgtagaaattaacttgacagtaatcaaagaggtagccaccctgcttggtttgaatcacagctccgtcactcacttgctgtgtgaccttgggcaagttacttaacctctctgtgcttcagtatcctcatcggtaaattgggtctaacagcagtgcctagttcctggggagtgacaaaaattatttaatactcttaaagctcttagaacagtgactggtatgtagtaaatattacataagtggtagtttaaaaacaacaaaaaaaaaaacacctgtaccattaagggctgagatggcagacaaaacctgagcttaggtgaagaggagtgtaacctagcaacattgtgctggactagatgaatccgcctcgtggaactacagccagtgagtaggagttgtggaaacagatttaatctttgggaactgttttgaattatttaggtatcggggctccgtattttacaagaagctgaggcagaagccatgtcatatggaccagctcatcatggtgtgagcataaggaaagactgacttcgtggcagatggtcattctaaggttccctcagggtcatcagtcatgagcccaaaatagcacgatgctgcagaggctgccatcctgagggatgcggctgccgatgtggttgctgcctggccttcatcccctcagtacccaggcagagaccgagtgggatggtaccacttgctcccttgggtggggaggacgattggagaaggatgagtgggctcacaacaggtgcccactcagcggaatccaatttcctgtctctgaaaggagaatcagtttgtgaaattgaccttaatcaagggtgatctgttcggagagtgctctatggatgccattcttttctgggtcttttggccagttatggaacaaagctcctcagtacctggcattgctttgacactggcatggagtcaggcatggtggctcatgcatgtaatctcagcgcttagggagggtgaagcgggagggtcacctgagcccaggagtttgaaaccagcctgggcaacacagggagagtttgtctttccaaaaaatgcaaaaaaaaattagccagatgtagtggttcatgcctgtagtcccagctactcaagaggctgaggcatgaggattgcttgaacccgggagttcaaggctgcagtgagttatgagtgcaccactgcactcccgcctgggcaacaggacgagacccccttcctaaataacaaaacaaaataacaaaaaaaacccttgcattaaccttaaactgggcctctcataactgcctggctccagaccattccagccccccacttccatgccctaaaatgtccagatcctgacctgcaattgcctgaggccatgggtcctgaaccccttcaccccttcaccacagactcaactgcatgtgcctttcctcctccctctttgctttcctcttctctttcttccatcatttctagtgaacattagataattaattttgttgttttcctaagatctacgttcttgagggcatgcaccgtgacttatataactttatattcactgttcccctgcccaggcagacccagcagaaaactaacctgtgtcattcatgttagttgatgaataagcgaataatgcaaatcaggcttttatgctctcactctctaacccactgccatcaggtgcctgaatattgccttctctccctttctccctcccatccatccatccatccatccatccatccacctgtccatccatccatctaactactaccccctcctcctgcagtctcccatccatccatccatccatccatccatccgtctgtccatccatccgtccaactactaccccctccccctccagtctcccatccacccatccatccaacccatttgcttctctgtacctctcactcttgagcttgttgacttaacatcaggaccattgatggttcctgcctacagtccccatcaccttcctctagcactggcgttttaacatagaaagcttaatgagtgcattcagttctgctttggaacaatgaaatgttaactttgtaataactcaagcctttcacataagggggaggaaaagattcatttcacaatgatactgagaattgtgtaggagctaatggaaaaaaggtcaaaggattttagatcctagaaatgggacaatgacaaaaattagtactattaagaagagtgatgtgctgttatgaaaaatatctacccaaatgtccctttaaaaagttatatttccatgtaagggttataattttaatattttggtctgtttccgtaaaagacattacatttctaaatttgaaggcaaatttccaatattaaaagatcctgtcaatgattcatttactcagctttaaatcttgtcttccattcctctttgaaaagacctgattattattaataatcagctctgcctaagttgtattctccttggatagaaaagctatgtatttgaagatcttatgctctacaagaaaatcctgcccagcgattgacgtgacaaacgctgaatatttcagtgcacaatgacggtggctttcagctcatgaaaggcttcctcgtgccttagatagtcttcaggtttctttcttagtgcaaacttttaagtggacccgtgatcctctgccctttacagcttttgtatccttcttgtgtcgattctatagctgttgtcagcaactaagcaatcttgttttttctttagatttgggaagctacaaactgtatctttctaaaccttccactcctctgccacttactgagctgttggaagcaaagtttaaagtataaatgcagtgtccacattcacagtactggattctttaatggcagtgagtgtggttattctggcatcacagaaagggagtggacttatgcaggggtgggggtggagagccatatttctgcacaatggcagtcaccttggaagatgtaggtggatctacctaagcctgatgaggacctcattggtgtccgggagcagggtgctccctgccctgttctggggaatgtgaaaatcctctactgctgaaggccttttgttctaagggcacctccaacccccacatcctagtagtcggctgccctcagacttaccacatgccaaatatgtttcatctttaagaagcatgctatctttatacaattgaatgcactctttgaatctattttacgttttatgattttaccttttttaaaaaaagtatcatgaggtatttcagatatgcaaagcaagtataaaggagaacggcgtgaatgtggacatacccagctgaccccttgaaggtgtaaaagatcagcagcatggccgaatgtcccttcccacatctcctgtccctcaagacacagacactgacctgaacttgctatttaacattccccttttagcttctttttaaatttttataacgattttaaaaataggaagaaaaaaaaggcatatatggcaagggcatagctttgggacatgctgtggtttgaatgtttattccctctgaatctgatgtggaaacctaatccccaatgtggcagtattgatatgtggggctcttaagaagtgactgggtcatgaaggctcatggattaatggaataatgggttcatggattaatggttatcatgggagtgagaccaatggctttgtaagaagaggaagagggacctaagttcgcaccctcaacccccttgccatgtcaggccctctactgcctggattctgcagagtcctcacagcaagaaggccctccccagatatagtccctcgaccttggacttctcagaccccgtaattgtaagatatacattcactttctgtatagatcacccaatttcagaaacagaaaatggatcaacacaggatgcatccatgctctacgtggacatcatcctctttcctccatttcattggccctgaagacatctgttctagatcctctgtctgttgcccttcatgaatttttggacactaaacttggcctttaagaaaatattaatgagctttttatttaaaaaaaaaaagatcactattcatgttgttgttactattacagtattaaggacgaactctgtgccaggcactctgctagaaactttgcagatgtagctccctttatttcttgcagcagtcctgcaaggcatcgttcttcctgttctcagatagggtgacagagcctcagtgagggcaagtagcttgtccatggttagtggcacaactgactctaaaatcttttaaccacatcaagttgccctagcatactagacgaaatgtgttaggactcagacatgtctgttttacatgatacttagatgggaccatgtgctgtggctgtgatttttttttcccccttagaggcatgttggatagggtgtcttgtaaattaatgccacttggcatggcaggccccacgagacttggctttcagtacaccctggcacctcctgcagtattgctggaaggagtctgattcaggccttatagatcatttatattacagagaaaggcatgtgagagtctggaagcaaatataaagtgcgctgaactccttcagaaatgggctctgaaaggaatcttagtgactttaaagagcaaagctaggaggattggctgcgctcatggaaattttccttttacccctcactgtatctggctgttaaatgcctgtcttccagctggcattctctttcttatttatcgtgaagagttagattatgttaaattgaaaagtgacactgatgtattagaacccatcacgttagattgaggacagatacctgacttaaaatgtgccctttctgaagcatcaactctgaaagtatttggtgttcttcccatattatacagttatacgataaagtcacaagaatgggtttatacccatttgtattctacttcgagtcaagtagtaaaaatctgtgaaattgactgattttgctcagaataatatcagagagggcaataaatctaaactttggctctcataaaatgtgtttctgggaaggtaatgattcatgatcagatgcacacacagacatcatgagagtgctaagaaatagattcataatctttggctttaaaaatcgtagactgttttttgagctcaaccagcctgctctggagttcgacaattctgtgtagtctttctctttctttggctctcttgatttgcttacaggcataagttcagcctcctgtgatgtgttgaagaggaagaaataatgattaaagtgatagaaaacagttctgcaaaatgaaagggagaattgaatttgtgtaggttaataaaggcaagactaatgtaatgcggtctttaagtataagtgaaagctatgctaaagcatttatcctccgtgtccacggatggtcagaggaaatggaaggggcttaaatagaaatggagaggtttctttggctgtgaaaaagaatttcttaatcaggaaggtaaagggcatagcagtggatctcagaatgatactctgaagctgtttcgctgttgcttccctttgctggacgcagagctcctcaagggcagggcgacccctgcacattccctgcccagagcagtgctggtcccattcatcagtaatgcccctctcccccccagcctacaatccattccaggaccccacctgctggctccactttcagtacatagccaggcgcaaccacttcttaccatctccctcgtgaccaccttggctcaagccaacatctctgggcactgggttcctttggctgcccccaggtttgataacaaaaatggctttcattgtttttgatttgtttcttttgattattaaggctgagtatttttcaaatatgcagtattgattattaattttaaatgaatgtgttgtttgctgtacacatttttgcccattggcttttcagttttcttgttttttaaagagactaaagttatcaatgttatatagtcaagtatattacataaattttacatttagaaagtaagttcaaatgtagcaattagatatatacttaactaagttttattttagatacacataaatgtgatcatatattttctttttttttccttttctttttctttctttctttctttcttttttttctttagagacagggtcttgctctgtgtcctgggctctggagtgcagtggtgcagtcatagctcactgcagccttgacctcctggcctcaagtgatcctactgcctcagtctcacaagtacctgggactacagatgtgtgccattgtacctggctaatttttaaattttcgtagagatggggtctctaacccctagctccaagcattcctcctgcctcggcctcccaaagtgctgggattataggtgtgagctgccacacccgtcccatatataccttttaaaaaggttcatcttttcctgttttcccttttcgcttctttcaccttttctttttttctctttccctccacatatataaataagctaatgtatattttcttatttttctgtatagtcatttagccctatacagccatgtacatgtacaagaggggtgtgtatacacacacacacacacacacacacacacacacacacagtttttattgccgatgttttaaaaaattagatcatattttatatgctttactctatgttttcatacttaatacctaaaaaaaatcatggaaccccatttacatagatctaatttattcttttaaatatgtataatctcccatgctatgtatgtcataattgatgaagtttttccacaatttcttttcctttggaaaagccccctggaattttattttgctgtatggcatgagttaaggatctaaatttttttaaatggctagtgaatggttccttgatgttttcagaactgtttctctcctgttgatttctagctcttcctttattatatattaatgatttatatccactatggtctgtctttcagctcacttttctgtacagatgtcaactttttgttgttgcttttgagatcattcaaatcacttttttatgttgaaataacttgagacttataaaagagttgcaagagagttctggttttcccttcacacagatttctgtaatgttaacatcttacatgaccctagtccattcatcaaaactaagaaattttcattggtacagtaccatttactagagcctttttcccagttttttttcctgattatcttttcctgttctgggatcctttctgcactcccatgttgcatttagtcaccatgtctctgtagacttctccaatctgtgaccttgtcttccatgaccttggcactcttttttttttttttttttttttttgagacagattctgtctcttttgcccaggctggagtgcagtggcgcgatctcagctcactgcaagctctacctcctgggttcacaccattctcctgcctcagcctcccgagtagctgggactacaggcgcccgccaccacgcccagctaattttttgtgtttttagtagagacagggtttcaccgtgttagccatgatggtcttgatctcctgaccttgtgatccacccaccttggcctcccaaagtgctgggattacaggtgtgaaccactgcacccagccaaacttgacactcttgatgagtgctgacccgttgctttttaaaacgtccctcgatttggacttgtctgatggtttctcacgatcaagctgactcatcatctcagggcacttggcgtcaacatgacttgtcactggcagcgacagggtggtcactcggctaaggcggtgtcagccagtattgttccctttccacattctgttcttagaagcaagtctcttagcccggcccacatgcaaggggagagtagttaagccccctcctactagaaggagaagtgtcagtgactttgtggacacacattaaaactaccacaaaaaattaattaaattttgcgtagatacttggaggttatgcacatactctgcttttctttgaagttgtgcccactaattttagcgttcaccagtggatcttgcctgcagtaactgtttctgtggatttctaatggtcatttttctcttcccctcattcttctacatttattaatttgaattctcctgcaaggaaggtttgtctcttcgccttcaattatttattattcaatcattatttgtaattgtatggatttaatgtcattggataaccagtagaataagtccctcatgtttcttctcctctttaaaaaatcttgggcctttttattacttttttgtttcttcttataaacttcaaaatacttatttttcgttttcaggacattcagttggtatgtactttgaaattgtgttaaatcttccaactgaatctggaaagaaatagtatctttaggatccagtaattcttctatctcaaattgtggcatgttctttccattttcccagttactcatttaggccccttctaagttattcacttaggcttctcggtgttgaaggcatacgaatatgttagaccctgtttatcctggccaggtgcagtggctcacgtctgtaatcccagcactttgggaggccgaggcaggtggatcacgaggtcaggagatcgagaccatcctggctaacatggtgaaaccccgtctctactaaaaaatacaaaaaattagccaggcgtggtggcgggcacctgtagtcccagctactcgggaggctgaggcaggagaatggcgtgaacctgggaggcggggtttgcagtgagccaaaatcgcgccactgcactccagcctgggcgacagagtgagactccatctcaaaaaaaaaaaaaaaaaaatgacctcgtttatcctaaaattgccatactgggctcgtgacttctctctacccttgcctgagtttacttgctcctccaaatgctaaatttggaactaggtgcttttgatttgtatgtctaaatttgactaaattactgtaaagtgaatacttagttcatggggttttttaaaatttattctatgcttttctttctttgtctcctgggtgaagttttgggtccttgtctccatgagatggaaaaatattcctttcccagaactttgttactgtttagattactatgcaggttctgtgataaccttcaagtataggtgattttataaaacagatgtttttggtgagattgtagcagggttgtgggtttggctctcagtctccaacgtttctgttgggcaggatttgcatttcatatcctggcatactgtattaggaagcttccagcctgtgtgtctaatattatgggggaacacaaaacttccatttcctaatttttaatcccttgttctctcaattcttagccagctggcactggagtaatggcatgtaaggatcttagttcccattattcattggtgagcatttctaccctgactgatgtgtgctcagctacactaatcgccatcttttacttacttacttacttacttatttatttatttatttatttatttattgagacagagtctcactctgtcacccaggctggagtgcaatggcacaatcttggctcactgcaacttctgcctcctgggtttaagagattctcctgcctcagccttccaagtagcttggattacaggtgcccaccaccacacccggctaattttttgtatttttactagagacgggttaaccaggatggtcttgatctcctgacctcatgatccgcccgcctcagcttcccaaagtgctgggattacaggtgtgagctgcctcgctcggctgccgtcttttatttttttaaagtcaagtactgttttctctgccatcacataccaaatgattcagagtttttcgtctggatcactcctaaatatacacacacccaatccctgaatcagaagaccaaagtccttcataccttttgagatagcttattgacctgtagaaactgtggtgcattggaagcccgggtataccagcagcctggcccagtttttgtcttggcctagtggacttgtccttgttacagttcttggttctagttgaacaccctttaactttcttttttacacgtttttacaccctttgtccttcccaccctaacagaaatgtcctgaactcagacatttgcacaacaaattgaaatttttggcaaattcctttcattttcctagtatattccaaagcacagttaaactagccagactaacctgatggtttttgagcaagggaagacatagatgcggatgattaaataagacacatcactatttcatttatgagacattattgtgtaattagctatttcatataactgggtttttaaaatagctgaatgtaatatttcatcaatataacctttcccccattctttgtggttgggttaatgaaaacttttctaatatgtcttcacttctctttggagcatagtgcatataatttattctctttccaatgtcattgcaaggttataattaaaagcatgaattccctgtttcatgaccctagagtctactgaatgtttaatccttttttaaaaaattcactaactgacctcagctgtgcattctgagttcttacggctacatttatataatttacttatgaccattgtagattgtcattgtgctctctctctatcgtcctctctccttagccctaagggttgagcaaccagatcatcaggtttgacgaaaacaggaaggagggcctgggagggatggattgatgatgagtccttctcattgataaggaccctgagcaaggcctggtgagttctagatgctgtggctgctcccagcttgcatctctgtctctctggttccttctcctcttgcttccttggcctcctttggcccttggaacacgcccagcctgtcccattgcagggcctttgcacttggagctctcttctgggttttctcacctccgtcttcatgtggttctccctgttttgtgattcgattctcaaactccaacatttgtgtctccctgaaaactccagtgagaactctctgctgaccagctggaggatgaaacagcttgttagttttagtttagactttctgctttcatggattgagtaggggtattcctttttcttttcttcagcagagctgttctcttttactttttaactttttactgtgaaactgtacttaattatacattcacagaaggttgcaaaaactattcagagaagttccatgtacccttcacccaatgtttatattttataccactgtagtgcaatatcaaaaccaggagattgacactagtacaatgtgtgtttgtagttctttgtcattttactacatgtgcagatgtgtgtaactaccactacatccacaatacagtgctgggctggtctcacgcctgtaatcccagcactttgggaggccgaggcaggaggatcacttgagcctggaagttcaagaccggcctgggcaacataccaagaccttatttctaaaaaaataaaaataaataaataaaaattagccaggcatggtggcacgcacctgtagtcccagctactcagcaggctgaggtgggaggatcacttgaaccagggaggtcaaggctgcagtgagccatgatcatgccgttgcactccaacctggggagcagaatgagaccctatatcaaaaaaaaaaaaagtgctacagagctgttctgtcaccacagacatccatcccccttgtgctgccctgtaattgtcataccttccctggcagcttcccaacctggcagccgctaatctgttttccatctgtacagttttctcatcttgagaatgttatgtaagtggaccctacattaggtgaccttttgggattggcttttccccccacttaacctaatactcttgagacccatccaagttgcatgtatcaatggcttgtttctttttattgtgatgccggattctgtgcaacagaggtagcagtttaactcttcaccaattgaggaacatttgttgttgtttttgtttttgtttcatcccaaggttttggttgttacaaataaagctgctatgaacatttctattcaggtttttgcgtagatgtaaattttcatttctctgagatgaacgttcaggattataatcggtgggtcgaatgtaagtatatgtttggctttttagaaactaccaaagtattttccactgtggctatactatttttcattctctcagcaacatatgagagctccagtttctctgcattactgtttttttacattagccattttaataggtgtggaagggtaggtcatcatggttttaatttgcatttccctaatggctagtgatgctcaacactttttatgtgcttatttgccgtttacatattctctttggtcaaatgcttcttgttgtactctgcccattttcttttcttttcttttctttctttctttctttcttttttttttttggaaacaaagtcttactctatcacctaggctggagtgcagtggtgtgatcttggctcactgcaacctccacctctgaaattcaagcaattctcccacctcagcctcctgagtagctggaactacaagggcatgccactgtgcctgattaatttttgtatttttagtagagaaggggtttcaccatgtggaccaggctggtctcaaactcctgacctcaagtgactcacccacctcagcctcctaaagtgctgagattacaggcttgagccactgcgcctgttacactttccccattttctaattggatttttttaattgttgacttttaagagttctttatatattctagatatgtatgctttatcaaatttgtgttttgcagatattttcttccagtttgcaactggtattttcctctttttttttttttttttttttgagacagagtctggcctgttgcccaggctggagtgcagtggtggctggaatgcagtggcatgatctcagctcactgcaagctccgcctcccatgttcacgccattctcctgcctcagcctcctgagtagctgggactacaggcacccgccaccacgcctggttaattttttgtatttttagtagagacggggtttcaccatgttagccaggatggtctcgatctcctgacctcgtgatccacctgccttggcctcccaaagtgctgggattacaggcatgagccaccctgcccagcaatattttcctcttaatagagtctttcacagaacaaaacattttaatgttgatgaagtccaattgactgaattttttaactcatgaattatgcttttgctgtcatatctaagaactctgcaatttctctgatatcttctcctaaaaattttacagttttacaaatatatttatgatgttttatgggtttatttttgtattcagttatatgagggtttggctgaggtcagttttcttttttcttaagaatctccagttgctttggtaccattgttaaaaagacttcccttccttcacagattggtttttgccctttgtaaaaaatcttttggccctactgttacgggtctctttctgagttctttattttgccccattggcctatttgtcttttcctttgccaataccacactggatatagctgtatatctggtagacttattcctcccactttttgcttctttttcaaaattgtttttgctattctaattcttctgcctttacatattatttttagaatattttctctataggaaaatcttgctgagattttgaaggaatcacattaaacacgtaggcctgttcggacaaaaccagtatctttactttgttgtgttttccaatccatgaactctttatcactctccatttgtgtagaactttgatttctttctttagtatttttgtagttttcagcatacaagttctgtacgtatttgctaggttctcacctatttctgttgagtgattgtcagtggcgttatattttaattttggctttcacgtgttcattgctattatagagaaatacaattgggggtggaaggattggtgagatattggtcgaaggacacaaaattttagttagaaggaataagttcaggagatctattaaacggcatggtgactatagttaacaacagagtgcatacttgaaagttactaagagagtagattttaaatgttcttaccacaaaaagaaaaaaaatacatgaggtaatgtatggttaattagtttgatttcaccatttcacaaggtactcatatatcatgttggacaccataagtacatacaatttttattcgtccattaaaaagaaatttgtgctatattttatgctactaaaaaatacagttgttttttgtatgtgtatcttgtattctgaaacccttgctgaacttatttattacttcagtgagtgttgttgttactgttgctttgtagattccttggtatttcctgtgtagaccacgtcatctgcaaatagaggcagttcactttttcctttctgacttgaatgcctttgtattgatgctcaaattgcccctttcttgggtagcgggagcctcttcaggttgattcttgagttcttgtgacatgacgtagtctttgctttcttgctatatggtataagatgttctgggttcctcttgtactttttctgccctgacctataattaaccatttctctaaaatgtactggttcttttttgtggcaaatggtattttgagaccatagcagttcccccagtggagactgtagactgtagacttatagagccttgatagtctcttatatattagtaaattccccagtaagtgctcaataattgtttgtcagaagagtaagtgaattagtgaacaaatgtatgaaacacatctagtgctagtctttgcttggtggccaaaccaaaacaagaaaaacatcatccagtgtatccaaaaaagaaatattgtcaaggcaattcagatcattagtgatctgtcaaagaatgaccaaattaatggagaaccaaaacacttctctttaaaccctttttctccttccaagtcacctccttgtagctggcctggctcctttgccccctcttcttcctttacagagctattctagttttcgtgcttctctcctcagtgtgaattttcaaggtgttcctcctcctatagatctctgttgctaccacaaactgcatgataatgccctgaggtcaaagacaaggaaagactgcaaatgcttggcttgtagccctcccaccatcttcaaagtcagcagcgtaaactttctcctctgccagtgactcttctgacttctctctcactgctgggactttgtctcacatggactcacccaaataatccaagacaatcttcccatctttagatccttaacctcaccatatctgcaaagtccctttcccatgtgaggtaacgtatctctaggatgtggatgtccacattaggatgtggatgtccacattaggatgtggatgtccacattaggatgtggatgtccacattaggatgtggatgtccacattaggacgtggatgtccttgggggcccttattcggcccaccacgagaaggctcatgtgacccaacagacggctaaagagttgggccccagagctctgtgatgctcacccttccctgccttctccacccagcagagaccgttacctttatagaccctagcgaagaattttctgtggcctttggtcctttgcagaacttcacacctgttcatttgaatcattttgcaccagttacatactgcttgtggcaaacctaaaacgcctgtggagaaatgtgacgaggactaagaacaaatacatcacaacctatgaaaccacgttgcagttctctgaggagatgaatggagcaattacgttttatgttattgtgttgtgtttgtcatggaaatgaactgcacaatcattaactggcaggtggtggagacgggaaaagtagctgctgcccctttttctatttttatccagttttttcccgtttttatttttgtgtggggttgtctgggaactaagagtgatattacctaaatttgcttcctgcctgtatcttacgtgtgtattgttgtggttaataatgttttcaatttactcagactttctcaaaacggccctttttgagttatcgatagctgtatttcacccaggcaaatctgaagttgtcatcttattttctcattttagatatatcctaatgttaaataaaaaggaatttataaagccttacctgggaaagtccaaagttcttaccttttgagaaaaaaaaatctaccccatccccaaaggaaactgctttcattagtcttcatggacggaacccagggctcatagctctgcctcttattagcgggactgacagctgcctagtggagaaggtaacctccagaacagtcccaaagaaggccaagaaggcctgcctaggagggttctatcaggataggaaggggaagtgcttaacgctgacacacataactcgggtggtgtgggggctccctcttgagacccagcatgctgtggtatagtcgcgctcccggtagatggtaatgccaggggctgcctcaagcccaaagattcagaaaatctacccctgcatttcgtcaccagttttgtgatcccctctaccataggccaggcctttcttagccagtgggggtatctgattggagacctatagaaagggggagacagagacagacaaagacacacgaagacaggcacacagagagaaacagagagagtgggccaaggtgcagaactgttaacctcacaacaaaggtttgcacagattcctctccctggcatgttgtctcactgggtctggggccagggagatgacagagacaaccattaaaggacttgatgagagaatacatttgggatgggcacaggctgggaggctgggttagagtcttgattgttcatgttctttggcaaaattatttgacctctggtagcctctgcttcctttctgtaacatggagataataacagcagctaagcatttctgagttttaagtgtatgccaactgtatgtaccaatcaccttttaatatctcgtttaattctcctgccaacactaagggatggatacaattattatccccatctgacctgcgcattggtgctgtcagtcaagcatctggcccgttgtcaaagcgtcaccagctaggaagtgtcagagaagggactcccatgcagtcatctctggatccaaaccttgatgttaacccctggttgctgcaagggaatttgaatccctgtgggatgaccgtgagggctaggtgagatgcatgcagagcacacagcagttgccaggcccgtggaacgtgccctcctcatcatgacggcgaggagggcagagcagaagctttgtagagaagaagagttgacggggagcatggtgccccttctgagaagtgacaaacaactccaggtggtggttgagtgaggagcagatggagggtcggtccctagggaggtatgtccaaagccagcaggttcactccctctgaaatcctacacagaaaaatctcagaatgctgaaaggatgccagtgtctgtctcccaactgtggctaatggttcagtgggatttgcttactggcaacttctgaataattcccagcacaggtgtaaataatgcaaggcctcaatcccagcccgacctgcaccgtgaggcagaagagacatgtgtgtcacagttaaccaagggtgcagtaagccctcctgaaagctcagtttaggggaccaggattttaaagagctcccagccttgttgataaatcagtttccacctgatggctgtttgatacatcagtttctacctgatggctgtttgaccatttccctgtacttgttttccagaacagtgtccatcgtcacagagagtgatggcactggcgggctgtctgataaagcaaagaacccaacagatgttgtttacacacaaatgccatacctatcgtagtagcgttcagaaagaaaaaaaaatcattaaaaattggattttcatattgatttattttcatcttcattgttgatggtgtttgtgcgtgagcatgatctatccctgtagttaggggagcctgtgttttgagtcgtgcactgaggatccagcatcaccaagggttattaggctgttcttgcattgttataagagaatacccaagacggggtaatttataaagaaaaagggttgaattggctcgtagatctgcaggctgtacaggaagcatggtggcatctgcacctggggaggcctcaggaagcttctaatcatggcagaaggcaaagggggaggaggcgcgctacatggcgagagcaggagcaagagggaacgagagaagggggaggtgccacacacttttaaacagccagatctcacaagaagtcactatcgtgaggacagcaccaagaggatggtgctaaatattcatgagaaatccaccctcaagactctgatccagtcacctcccaccaggccccacctcccatactaggaattacagttcaacatgagatttggatggaacacagatccagaccgtatccctgagatcagctgtgctcgaggtgctgtgagtctgccttagccatcgcaggtgctcccgtctctgctgggcacagctttgtcactcggcaatcgaaaagagtcttaacacgagagtggaaccctttggtcaaaattatgctccttcaaagaggaacaaatgtggtgacagactggaaaggtgatggaaagcatttcaaaaagcagttcactctgctcataattttctagtattcctctgctattatttgcttttaaagaagagccctctgcttcctagcggctgctgcgtatgcttggtccagccacgaagacataatcctctgcgggcagcatcacgtggagcgagggtcaagtcctctgcctggtgcgcctttatctgcacaagggaagaaggaatcctgagtgcctcgttccgcagaaagtgagacacagaaagcatttgacttgtcaggaatcgagaattaccagccccaggcttccccaactcagctcacgaagtaagaatggctgggccaacgcttctctgcagaggctgcaggtgcggacaccgacagccatgcacagtcctcccaggaatattcttgtatctgctgtgtcttgcttagccatggccatatttatttaatttttgatggaattatttattgtgttttattctcttgctatataaactgagctgatttcagaattgactgctgtttgcagagtatcctggggagaggaggattcttcatgaggagcccccccatatctggagcagttttagttggtcctcatctactttttagacgcctttctgtcctcacttttcatggtttccaatttgactggattttacactcttgggaagttccactgtttaaggatctaaagactgaaaacatgtattccgcacattttgtttaaatcatgtttcttttttttttcctggaatttttattttagcagaaaaagtcttggctggaaatgtttctgcctaaacctgggctctgtaaaaactcctccttcatgccgttcctctgcatatgaccacaccaggaatttggcatagccatttatttgtacctagtgctgaaacaattagttaaaataacaaaaggcccctggataagtacaaattgactgaagtgcttttgaagattagcaaggaaatttaagaaacattgctataaataaaaaatatatttattctgggcaaaaatccctgatgaaataaatccttcactagttacatcaacagttaccctataatctcttcatttcttttctgtccctcctactagacagcatctttcctaaaggaaaagaatcaattctatttatgacacataaacacatgtggagaaaaggccagggattttccagcactaaagtcttgtaaagtggattttaacgttcgtggcatctgggtggaagtatccgaagacaagttgtttctaggcctctttgctaaattattacatgtacgctcttgagcagatgggctttgttttaggtaatagaggcttctggtcattttatgactctaatgtgataattcagtgaccgagctgtgtttttacagaagcctattaactaaaactctaggaagtatttgatatttagcccctagaagaggacagtagatgacatttactgttttcttacttgccagtcacattctacacctgatgaaccagattcagacttagcgtacatggaatttgtagcttctgagccagcctcattcacctcactaccgatttgcacttcatcagtgtccttttgatgtcagaattgttatccccattttacagatgagaaagccaagtgatgagcctgtgggagtaaaatcggggccagatccagttccacttctcttgccccacccaggtcacagttgcctgatcgcgttaagggcctctctatattaagacagaatatcatggtgtcattgatggtgttacttcctgtcaactgtgatcatcttgttctggtagaaaagtgaggtgtcttctctgcagaccacattagattttaactttaagtcaggttcgacactacttctggttccaggaaactcagggagcttggttgggagaagatgcaagagctctgagctcacatcttctttgggctttaattcagagaccgacaatatgcacccaggcagatgtccctctgtgcctcttttctgaccacccaccaaagcccctctctgctgctgctgttggccatggtgctgggagtagtcagggagccccaggccagccccgcagttcaggagggagttggatgtgctgcctggccgtgcagaagcccccggccagagctccggtggaaggcacgtgggtagatggtcagcagggatggcatttcctcccacgccacctgcagaagcagccattctgttcctgagttattaataccttgtaggctagagaactgggtctgtcttgctaatgtgatatcccatcagatttttacactttcaaaagctatcactagggaaacagatgtggttggacctgcgtgctttgtggtgactttgctgcctgtgtggcgtatctacttttcctctaaaactctgtaaaatgaacagactggcttcacacacttcatactgccatcatttatctttttatgcctttgcagctcttgccagtaagatatccccttgtgttcaacaaccatattttccagtatgtcttccctggacagtgttaacacacacagtaggcactgcaaagatatttagaaaatggttaaattactcctgtatttgcttgggttccaggtgcctgaatgtgcaagctcagaaaggaatagtcagagtaaaaatgcaaatacaaatacttagagattcccttctttttcttcattaatttaacacacatttatcgactacacactgtttggctctgtgattaaatactggaggatccttgtgtgcagggaaaacaaaggtgtatctgaacgtatttcaaatccaaaggattttaaaggagttaccattttagaaattccaccctgcaacttaccaccgcttgggtctatatttaagagttgagagacagtcaatatagaagagttggatagaaggtgaattcacataaattcaatggaatttttccatatacttgccattatgagattaacaatgactctcctagaaaaggatgcccgcgtagactaacttgaaatgtttttcaaggcatgggccattatggtaactaaactggtggaggcttgactggtcttttcctgcctctagtttcttccctctctggtcatcttttggtctttctcctactgcagaagtataacttaccctttcctgaagaatcacagttctgaagtttaatggctttctcctctgagcaagcctgcctgcctgaatgcagttgtgctgagctgcaatcccatttgcccaggacttcttggtctgtgctagggattcatgcattccattaatgaacacaactcagctagtggtttctgttggtttgaaatcacgagaaacaggtttcccaaattctttcttcttttgcttttaagatgtttttcttacacccagagcaaatggtcagcagcaagtgtttgctcttgatggaataaacatatcactctggcgacttaacatgtactgagcattcagggactcattagtgccaaaactacttgaaagcaattttatttttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgttctcattgttcatttcccacctatgagtgagaataggcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcagtaaacatacatgtgcatgtgtctttacagcagcatgctttatagtcatttgggtatatacccagtaatgggatggctgggtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttgctgttttggacataaagtccttgcccatgcctatgtcctgaatggtaatgcctaggttatcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccgttgatctgtatctctgttttggtaccggtaccatgctgttttggttactgtagccttgtagtatagtttgaagtcaggtagtgtgatgcctccagctttgttcttttggcttaggattgacttggtgatgcgggctcttttttggttccacatgaactttaaagtagttttttccaattctgtgaagaaagtcattggtagcttgattgggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtatgttgttggtgtgtaagaatgcttgtgatttttgtacatcgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttctatgctggattacatttattgatttgcgtatattgaaccagccttgcatcccagggatgaagcccacttgatcatggtggataggctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccaaggatacccaggaattgaactcagctgtgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactatctctcagaccacagtgcaatcaaactagaactcaagattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagagggcaagaactaactaaaatcagagcagaactgaaggaaagagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctataagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaattgaaagcaattttagttcttgtcgttgtacagctaaggaaagttcatcagtttctaagttgtctgccttgaacttgcttaaattgtgaggcatgagatccagattatactcagaacactaagccttggaatcaacccttttaaaagttgcttaattaaaatggagaatattttgaagtggtttttttttttaagattttacaaactaatattctgcatcttcctgcacgctgaccttctgttaatgtacttgaaggtcaattgaaactagtcaaatgttactttaaagttcgtagtggtaaaactatagactcaaattatgcttctatgtttaatgggcaaagttattattttactaaacattttactgaattttcatcataatgtataaattgatgtggatattaccaccctagtttgtggtaagtgttaaagagcaaaatacttattgataaccaaagacaatttatattttcatggaagccaacggatgggttacagtgcaagttttgggagctcatcatgaaaatgttcacatcatgaaaatatttctggacacctcctggaactcttccccttgggtccatagatactcttaagggaaagttgttaaagtgccccctgttacttcttacagcttgtaagtacacccaatcgaagctctatgggacatgaacagtgtgtcctggttcaggttagtgtctcctccactctgagcagggagtgggatttccaatagttgctgattaaatagtgaaacagttacttgattctgctccagtggtgatcagggtgaatgtatactcttactcttccttcctggtcttcaggcacctatgcagtgcccagtgggctgttttcaccaaccataaatcctgtgcttccaggattccgacgtcagtatcacatccctgaaggcagctgatctggtgtggtctggggaaggccacaacccctggccatgcaaacatagcagggagcttcccagtcgatgcctagcaaggtggccctccctcccccatgcccaaggggtgggtctagccatcatctcaatgcaggtggtcagagacccagctagctactctcttcctcggatttcatcttttctgaaatagagaactatgattttgcctagcacctcaggagagtgttggagaatcaagtgaagaatggccagaagcacttagcgagtgctcactggaaatggtcttcctttactgaactgcacagatactttgctcatcagtctcagcaatgaaaagcaacagattgatttctctcttgtgaaaacccttcctgtgcttataattcgtacctcaggaccggttagcttgttctttatgatgtagcagtgtcttctcccgagcggcagctcatctcatccatattgtactcagttatttttgttcctcttctctttactactatcccatggaattgggagttaaaatgatgaggtttcatttttaaatgtacaaagatgggggaagactaaggaagtaattttatttaaagccacacatacatttgtttcaataaagttaaaggaaaatctctcaggccaaatattgtaatttttctatgaagtcagtgtaagttttaaatgtgtcatctggagctatgttataataaggccaggtaattcatattatgggcaaagtattcaactttgctaccataattactcagcatgcccctgtgttcttttcattaccttctgatagcaaaagtgatatttattgtggaaaaactggaaaatattttaaaaggtagaatcaaaaggaaatggcctgtaattgtaccactcagactaaccactgttaaccttttatgtgtacacacatatgtagaaacagatacataggacttatttgcagtgcatagaacccttaaatccaaaaaagatgtcatcgcatgtgctgttgtgaatctgtattggagtgttttgatttctagtgacagcagccctaacttatcacggttcaacaggaagtatctgagctcatgaaccaggaagtccccagacaggacaggctgctggatggttggttcattggctctatgagataatgaaggacccaagtgctttccgttctctctattctgctgccacaattatcagcttcatgtgaaggtcatttctatcatggccataaaatcaccaccatgaacacgttggacaaaatgatcaagacccacacctgatgctgggaatggggccagctctcttgtgttgcatggctggattgcagggggaaggcatggttgccacgacaaaatcagggccgctaagaaagaagacaggatgggcacacgatacttgctttagtgtctttaaatatggttttcttcttaaggtttacagcagttaccagaatttaaaattaagatgaatggttttggatgttttattttcatttaaaaagtcagtctcttgtagaaatgctctgttcagaaagatttggataggaacaaagacttggtttctgggaaattaatcttcatgatctccaaagatgtagcattttcatggtgtctttttggcagcagcagttttttttttttcatgaattttggcttaaacctttatagaaattaaaaactaaaagaaaaagataagcttaaagataaaagttataatagatggaaactttaatatttttatctttatgtacctttttattttcaatactcttgaaataatgccgtaaataatatcgagaattcatggatattttataaggatacttctgagaaacaataggcatatttgaaattactatggtaaaaatcagatgtcaaagaaaaagttatatattcagtttttaaattgtactattaaatgtgtaacttcatgtgtagtaaatattcatatttaattttagctgccagtgtaacatatactaaaataaaatggaacaatttctatggttctataaaagaatctataaaggagtcataaataattataataaaactctattgaaatatttttatgagactaaaaattgaaaacttcctaatagggaaattttcataaatgagacatgaagtaagtcatagagacctcaaacagtaatatatcctatgggaaccctgaataagcaataacttcttaagataattttatataatgtgtaaaaatcaagagtttttgaaaaagctctgcaaaaggtagcaggaagaaaaaggattattataatgctaaaattcctcatgagagattactcattttgcatgcttttgatgttaccagaatacagattttagataatctgaatctgaaagtgctgtaactattccctatagagtaccacaattgtggtgggtaacacaactcactctagagacctaagatgtttctcttgtttttgaaataagagcttagactaaatgatattttggtgctcagaatgcatcttaccttctatgccaaattcaccagccaatgaatagtttactcacattcatattttttttctttcttttttgagacagagtcttgctctgtcaccaggctggggtgtggcggcgtgatctcagctcacttcagcctccgcctcccaggttcaagcgattgttctgcctcggcctctgtagtagctgggactacaggcgtgtgccaccacgccgaactaatttttgtattttcagtagagatgaggtttcaccatgttggccaggatggtctcgatctcttgacgtcacaatctgtccacctcgccctcccaaagtgctgggatcacagatgtgagccactgcgctcagcccatacttttttaaacaaattttaccaccctcatccacctctttaactggcaaaaagaatacggaattataagtgaaggatcccataaaacacccatttcaaataaaagttccttggatgaatggaagttgtgtctttcttgtttttattcttttttaaaaattaagtagtataatgagagtctttctatggtatgattggatgagtattaatctgcctgtgaaaacaccttctcccttctctgctgttaagttgctgtgttacctaagacaagcaacttaacttctgtgagcctcagtggcgcagagaaagggcaggtgcattaaacgagtctcagagatgcctttcccagtagaatcaggatgaatgagaaggtcttggtcacgatcaagaagactgtttactcatcctttgcacttctaagacatggtgagatagtacaggtgaaaaagacgtggcctggagttaataatgatggtagaagttaagttgaaggggggcagcactgtgcccattggcgactttccttctacgcaccagtgtagatatccatacacaaagcctctgatgaggctccctcgaggtggagaaaaccacaactaattcacttgcgctgggtcagggttgtggtggtccagccttctaattgaagggattccttctaactggtcttgttatgcattctcagaggaggaacctctgagttttaatgaactctggatgtctatgttccagaacattgtcttcttcacagtcaggtgctggcgcagatgtggagcacccggtaggctcagacactggggctgcagtgtgccagctggatcagaagaggctctctctggcgttgtcgtattcttaaagtcggcctgtgtattgtttttgtccttccagctcttcttttaaactctaggcattcctttatagttggcctaattaattttgtcttacaagtaggaagttccctggagtagctttgacactgtcctcttcttttctgaaacagagccatcacattggagaatcagctggtgatcctcgccaccacaaccagtgatgccggggcatactacgtgcaggccgtgaatgagaaaaatggagaaaacaagacaagcccattcattcatttgagcatagcaagtgagttttgaaatcccaaatggtaattctgcaagcaataaaatcttgctttaatcagtaaccactgtctgacaggacattttgcaataaattttctctctctagtgtagtagttacggtttaatattgatccagtgccaatagttcggagagctttagggctcttgctttcttcaaaatgatatgcggaaaaatgtgaatctcagtggtacttctgaatgccagatcttttttgggaattaaaaaaaaaagtatttgctttttatacacagtcaatgcatgttgttcctaacaacaaagaactttcaatttaaatgaattgtatccatgaacctaaatcaggactagattagatatacattatattcttttaatctaacaggaaaatctttgagaaattctacctattaagttgtacgaaaattagcagtatttaagcataatcagttgatcattttttccacctaatttaactgaaagcctgattcttgaagacaatgcacacaaatcatgggtatttgtcgattttatttgaggggactttagtttgagtaaacttagttttacatgtttggactttaaattctactagcaagagttaattgctaaagaagggaaaatcacccaaagcaggaactctgaactaatctagattcagacatccatatcagaaggcttgtcatcagatgtttgcagcatgaagcttcatggtatgaaatgaaattgtcatgcggttgagaaaatagggttgaaactagtcatggcggatggtaaatttcaaaatattattatcatatcatatgagtgaattatattgatttgtttgtatagtagtggattttatctttttaaaaattgtcttgaaggaatcgtttcccctgcaagtgatttgaaaagtatgtggggctaggcatggtagctcacacctgtgatcccagcaatttgggaggccaaggcaggcatattacttgaggtcaagagttcgagaccagcctggtcaacatggtgaaaccctgtctctacaaaaaatgcaaaattagcaggcatggtggtatgcacctgtaattccagctacaggggaggctgaggcaggagagtcacttgaaactaggaggtggaggttgcagtgagctgagatcatgccattacactccagcctgggcagaaagaatgaaattccatctcaaaaagaaaaaaaaaaaaaagaaaagtatgtgggatggagtgatagtatttgcctgacatggccctcgaggggtacaattgccttaggcccagtagaattgcctgggtgaatctttgtagcaaactctgggtgcaggcgtctgtgggagttaactgagtggggtctcagatgcctgcctaattggtcccaagtggccgtgatgtgctgtcatcctgccttgagctccttaatttgaggaattgaatctcgctctgcagaacgtagacttggcacagatttaggatgagtggggtctttgtgatgccatggagaatgatgcacgtggattaggggtggggttcacaaaacccagtgcatgctgtactgtgacgtaaaggagtgtctgcattgagaattacagtagaaatgaggatgatttattaagattttttccaagggttatgataaagaatggaaattgtattatcaaatagattgttattattttaatgattccaaactttacaggtagagccatttatcttgtttagcaaatatgaatctgtactcaattgtaatataactaccaggataataatgagtcaaagggggtgaaattctgcatcagaaacaaggaagttggccttcctctgttagaagaattattccactgaaactgtttaacatcacaaagttataaaacagtccgtacctagtacttgcctacctccctactctgtaagggccagcagaaaataaagcgagtacagtgaatttgcaaaccgctgtactagcgtaataccatggtgttagataattggaatatgtaaatttttttcagtaatttcagtttctaccctgaccgaaaagtatattgaaagctactcataaatattataattaactgggttgcattttgttcctttgtatgtattttttaacttttcattggcaccaggtaaaaatgtgtaaaaagtgagatacaaggcagttgatgatatggacttattttaaatcttaggacaaaacctacattttgttcctttatgaattctttgctttttatgagtgccagataaaatgggagaagtaaggagattgaggaaactgccttattttaattcttaggagaaccttcctggtgacatacgggatttacgtaaatgttaaatggcaaccaattatgcttttttgtttttttgtgttttttttttttgtttttttttctgctaaaagttttattttgaaaacctctaaaagtcagaagtcttgattaatctgcagaatcccccagaattgttttaattgtgcttctttctggcatccagtgagggctctaagcaatgaacactgcagttcaggacctggccaccctgctcctggtgagggtgtgatgtattgaaggatgcgtctcttcaccagatttattatgaaattagatattctcaagacctattgatactgggagtaagatagagtgtgttctgcagacttagatatctttttcttctgatgtaggcttttgtggaaacaccacacaagattgaggaaaatttgtaaaaactttctggccagcgtttctgaaaaatcaaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttcaattgctagatactgtggctacacctgaagcttatgggaagcaaaagatagataggttttagatttaaatttttttttaaagaaagcatgactgttagaactgagatgcagtcccataatggtaccgcctgctgtttagtgcatatttagtagatggcattattatctctcaacatttctcccctcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctctaaaaaaaaaaaaaaaaaaaaaagccacaggcgatgagacgaattctatacagtggttaatcagtcattgtttatacgccattgtacatgccttagacataccatcagttctgatccaatattcaaaatgtccaatgtaatgagattctctactagggatgaagcttggattaaaaagaaatgactgcctctctccttcctgtttttttcacctctttcattttaatgtctcctcttcaaacaacatttgcagataggatatcatttcagctgatcctccttcaggctgacaaacccttgcttttaattctgaagaccacttaacattcttttgtcctctataatgctaatttaactgcagactcacgtagggttagtagttgaaagtggattcctgagaatgtccatgaacagtcatttcagaggactgccctgtaaaacatggcttttgtgtgcccaggtacaactctctcctattttccttgtaccgttaacattaaagggagagaggggaacaggcagatgccttccagatggcctctgacttggctcgggttcctaaaacaataggaactgtttgaaatattactaaaaaccaatctggggcctagccccacatcacaaatgagcaatttagaaccaagcatagttttatagattgtatgacactttactgccagaatttttcagaaacataaataggaagtctattttatagtcaagtcatgagtttaatcatttagccatgcatcgaacctgctgtacggagtgaagtgtgaggcatgctctgccctggcctcctgagctggtgttggacagaactaagtctaggccatggtccctaatgcttttccgtaaacacaccatcaggaaacaagccttgagcatttactccttatgcatgaacacctagttacttatcaattctaagcattaaccatcagacagaagagaggacgggaatcagcagtgctaatcatgaaggttccgttccgtctttacttgacgtctcatggcgcaatatgcactttgtgaatggaaatccatattttacttgattttcttgatacaatctagttttttggaaaaattcttatgacatctggttacagataattgtttcttcttggcgacgtggcttctactaacgacacaagtgttcctgctgccgtttgttgccatctgattgtgctggtgttgtgagtgactcagatctgtgctttcttcccagaaatgccgtcgtcttcagttgtccactttgtgagagttagtttagataaaacgaaatacacaaatacataaatccacctctccgggcaaaggtgaaactgcatcccatgcctatgagggcatcctgtccacttctctgacaatgagaattttcagacccttccttgggatagcttgcgtacagagtgtcacctggggccacctgaccaacagactcaacctgcataataaataacattgaaacttagtttccttcttgggctttcggtgagaaaacataagttaaaatactaggtctaatatttcgtttctgcgccccaaatggatggattggggaatgagttttagaagaggagtgtagctggtggctcccagcaagacttcactcaccacaacaaagaccatcattctctcctcaccccacaaggcaaaaccggatggtttctattgcccactcatgcctccttcaccatatccccatctctttccatcccaaggtgtccccttttcccctgtgtgatttatttcaacctgatttcactgttgttaaatcttaggaaatctaatctgtcttaaatcttaggttaagctatgatcatttgccctcaaagtttgaacacatatgggggaagctcaatatgcccggtttcccaaagcagcagtcactggtctgagtatcactcaggatacatatagatttccaaggcgtaggcaggcatgtaaaatttccaaagaacctattttcagtcctttcatattcacattctaaaactggatctgaggatgcctgaggtcaaattttgcaactgctcctttctttccgaacgagatggaaggctcgtgtcttactcatcctgaatctttaacatgggcaattatctgagggtgtaaatgcccaggtgccaaccaaagggagaattctaaatatcaggggcagaattgagaaagtgaaagactctgataactgagagataaatgattttataaatcaggtgttttcaatcttttgctgtctacaaaacgaggtgggacctacgtgtgttgtcagctgacacttcattacaaataacttgataattactaactgtaacacagtccacttgttctcaggacggaagagatttctagcccctttgcaggtgcagggccatgtcagtggaataaagtgtcactttcaggccatgtgtttaagagccaatgtgttaccttcatgctctccctcccctttggggacaaccatggccaggccacatattgagccacaagatggaagctgtctggatatttgaatcagtacaggggaagaatagcctgggagggccacccaagcagaattggactcgttatgagtaagaaacaaaccttggtatgataagcagtgagatttcagcatttatttgttattagaacaaagcacgtctgtcctaactaatacattactatatgacaacagggcgcattgcctcacgcctgtaatcccagcactttgggaggccaaggtgggcggatcacctgaggtcaggagtttgagaccagcctaactaatatggaaactccatctctattaaaaatacaaaaattataactgggtgtgctggtgggctcctgtaatcccagctactcaggaggctgaggcaggaaaatgaattgaacctgggaagtgaaggctgcagtgagccgagatcactccactgcactccaaccaaggcgacggagcaagactctcaaaaaaacaaaaataataataataaataaataaattactatatgacttttggcatataacttagaaggaatttaaaaaattgagagatattctataacaaaatttcttccattttcatctgttgctttatatgaacgaaattttatctatgaaaaagaaaagattagaattaaactttattcctcatgtcattgagagatgcatttctagttttttaaaatataaaacctattcatcaaaatttgtaatactttaaaaaattaattgaatgtcaataataattgtaacaataactcaatccaagagaaggtttgttttggtttggtttgcccccgagtcatatggttaaaaacatttttttaagaattttttgttcttttttttttttttttgtttttttgacacaaggactctgtcacatggactggagtgcagtagtgagatcatggctcactgcagcctctaacttctgggctcaagcagtcttgctgcctcagccttttgagtagctgggactacaggcatgaaccaccatacctggctaattttttaatttctttttttttgtagagacagtctggctatgttacccaggctggtctcaaacttctggcctcaaataatcctcccaccttggcctcccaaaccactgggattacaggtgtgagctactgaaccccaccaagattgaagtttatacgcatagttttttcagaggctgtgatatgattaatacaattctttgaatcatgtgttttttaaatgggtgatgctgtgtatcaaatgtttagacgtgcttatcaaatatttagattcctttgaatacatatagatgcgctgcggtagttttattaaaatatactgaaatagtaaaacattaaactataccagaaattatgttctttttagtccttcaaatttatgatgaaaaaatggtagatgtcagcttaaaatgtaagaaagatacacagttttacaaaattgttttaggtgatctaggaacaacaactgtttgaagctatatgcagatgtgattataaatcacacatgagagtactgttgatgaccctctaagggcatacagagaggagaaggccctaacatgtcttgagacctgacagatatcgtcacgtatattttccttcttagattccacgacagccctgtgagttaacaatcaactctgtttcaaagctgaggacactgaggctctaagaggttaaattattgacccagatcacaagaatagtcaatgggaagtttgaggattcaagccaaagtttatttgtccccctcccaaaaccctcgtttctccaatgaaagcagaacaacatataccatggaggctgggtgtgctcttgaggtcaaaacgtgtccaagagagaagcccaaggagaaggcaaaacttgggaggaggccatccagcaggaaggctctctgcgaagagctctgtgtgtgcagacctcagaggagcttggttttgttttaaaaaaggaagtcttctgttctgatatcaaaaccactcccgatcaacattcattccagagaacagcagtgtgctgtggctcagcagctttgaggctggcacccttttgcaaccccagtgaggcacgtttgggcggacagcaaacacaggtttggctcaagggtgcagtgggagatgcactggagtcagtgcttactaatggagcatcagaacaataagtcacaatttctgataacaaagtggttgttttgttatcagtaatgcattagacagcacataggacataaagtaagacatgatctgtcccagtggatttatatgactgatgtgcgtgattacactccctaattcccagatattgacatcgaactgttgtggcagattttgcacagtgagtaaacttcacccagggagtaaggcaagcacttggagaattaattcaccaagcagaactgaccagttgggttcagcagacggacgatgagtattcatttacgtctcccaattatgctgcgattattgaaagatacaaattattcagtagtgatttgcctaatcggattttttacaaactcctccacatagctcattgttagtaattcctccaatctaccttcccttctgtccccttgttaaatgtctcaatttaaattattatattcagatatttaagcataagagttctttaattttagcagtttgggggctagaacttaaagtaaccctaattttgttttgttttgttttgtttttggagacagggtcttgctctgtcacccaggctggagtgcagtggcacattcatggctcaccacagtctcaacctcctgggctcaagcgatcctcccaccccagcctcctgattagctgggactgcaggtgtacaccaccacacttggctaatttttaaaaaatttttgtggagacaggatctgcccattgttgcccacgctggtcttgaactcgggctcaaacagtcgtcctgtctcggcctcccaaagtgctgggattacaagagtgagccactgcacctggcctaacaatttttacctttgattttggaacctaatttcttagacttagccagcagcgaatgcctgatttcagtttatagggaattgaagataatttcattgtggaatcatattatgtaaacataacatttcagagtatgtaatatattgagagtgacccaagattataacttatgcattttctttctagctcttatcactctagatgtatagtcattgaagtactttgtctactctccttgtctctgtaattgatatgaaagataaggaatttttggagggcacaaacaagggggatggaaaattgaatttttcctgcagtcattttacaatctctgacatacatccattacacagcttgtctggaaaaatcctaagcaaagtgatggttattggccgagatgagaccacatagaacaagttgctagttgtaaatgtacttttcttagaaaaactgtatttactcagtagttgaatacagcgatgattctggtgaatttcctggggttcagcttttagttactttctagactaaatggttctactcgtaccttcccagtatgatttttccttttacgaatgagttcagtattctgaagctgctaattaagaaacacctgtttaatttcccttccttcagaattcttaaggttttcaaaatccagattgtgtgagttgctaggctaaattgtcttttcatatctcctctttcagaaaaatgaaaatatattattttctgattcaaagggagcacctagagtggtaccaacctcttcaatcataacatggtatttttgctgagtgtaggcctgatatcctatggtttaacttcagtttccaattttaaggacagaaagatgtgatttggttcaaagcataatgaaggcttattgtagtaatagtaacaacagctgttcattggatgtctgctgtatgccctgtatgtaaatatcgtatctcattaaaaaaaaaattaatcacccgggcatgttgactcatgcccagtgctttgggaggctgaggcaggagcattgctcgagcccaggagttcaagaccagtctgggcaacacagggagactctgtctttaacaacaaaaacaaaaaaaacgtgccaggtgtggtagtgcatacctgtggccccagctgctcagaagggtgaggtaggaggatcacttgagccagggaggtcaaggctgcagtgagctgagatcacaccactgtactccagcctgggcaacacagcaagaccctgtctcttaaaataataatataataatcataataaccaccatttaatcatcgtttttaataaacaagaggccataaggtcagtattatcccctttttgcagatgaggtaacaaatcaaagcaacaagttactttcactaatcttatgcagttgattacgtgggttagttttgaacccaggtttgtcttttccccaaagagactttcaccattttacttattgagatgatttatatcgcagaactgtttttgatttttaaaatcatgttgtaatttcttaatctggctgctgctgtagtgaatgcagcctaacgattggtcaccttttggtagcagttcaactccacctttaccacttagtcataatgttttattactgttcattgtaaacgatgttcttttggctcttgtagaaggcaattacagcaggtaattaaaattgtagttctttacaatgtgtttgagaatattaaatcaagcccacagaaaatcaggtaaagtatctgttaaagtgaaaggccacttaacaatgctgaagaccattagcaaatccagagtgctatattccctgcttttccaagaacacttcgtatctgagatgtaaagaaatggaatttatatcagaaataataggaaccagaaatttatctggagatgtagattctttctgtgtgttctaattagtgagttcttcgcaatagtctctctctctgattctttgttatttcaggtaattattctgcctgcacccctttaccttttatgatcttgaagaataccctgtttagcacaaaattagttccttccaatctagtatacctctatgtttggctgagagggtcttaggaaagtataagaaagcctgtgacctctgcttgtcagtgtaaactgttattttgcccaggaataactagcaagtgtagctttttgagacggataccaaagatattattttatgtagttttagagcatcataaaaatgtgagctgggaattccctagctcacctcagtattaggcctgcatgaccatctgggaagtgtgaaggctataacggttttgtggtttttctagggaggaagatacaaatgtcaaaactggaagtgcggaactctagagaagctcttaaaagaatgaaggcttttccattttagttcctaagtcgaacttaaagagtaggagtcagagctgacataagtcagtaatggcgagcatccggctggccccgtgcggtagtttgctgtttcactgatgatgtattttgttgaggtgtgtcccatctgacattaacggccatgtctggtattaaatgcccttctctttctccaacaggatgtcactctgtggttctattaattcagacagggttgaatttcacaaaggcttgctttcatttgggaaagttttcagcacaagtgtactccagaattcaaacttcttcctttctaatccttaaaacattgggatgtaaagaaatggaatttatatcagatttatatatatcagagacttatatcctcattagtcagaatgatgtaggaatagaaaccatatgcataggttgccctttggtgattggttcatttccgaaagcttaaggagtttcatacttcgttagcctactcaagaaaacttcacttgtcttgaactgagaaaatgccacatgcaaaaatggtaccatcatatttgaaaatgtatgaagcgaataggcagtattctgagtcttttgtttctttgttcattttacttacagtgtttgtaaaaaccatgacagcatgttcttgatgaaaatctaggaagcagttctacttgaaccctagcctggcattagatgacctggatcctattcacctcttcagtttgcacttgaaggatggatattaagccatgttgcccccactggcctccattttgattggctagtgaccctgccatgttactacagattttgaatatcatctcaacctggaaggatactgagggatgcatataagagtaaacttattatagagggaaacagctggcatactggcatcagcctacaccattttcaatgtctatgtagaagaaccaagggaagggttgaagtatgattttctttggcttttagagtctctgtctcacttctgtccctaagtgtatgattctccccaactccctgccctttaaacactcagactacagttctgctattccgctcagaaaacgctgagcgtctgatacttatcaggcattacgcttgatgccgaggacacttggtgaatatgacatgtggttcctgccttccctgagctcacttttgccaggagaggctggcgcaccaggaaatgacaggaacacagtgtgttaaatgccacacgaaagggagttgtgtagaagaagcttccgaagcacaggcaagggaacgatgaattctgcttccgatgctggaacagctttgttagcagaactctgaaaatcttttctttcacgtatggagggatgcaccagcagtgagatgattaggaaaagggggttggggtagaacagcactgtctatgaccgggaactgccataaccaccgtcctttcatttgctcccttgttataaatatcagtgccccccaggaagactctgcatttaatacaaccccattccaagagaatccttattgataattgtttttcatcacccactagaacgtaagttccgcgaggatagggatttttgcttatttccgcaagccacgggaagagtgcatgacgagtaataagggctcagtaaatacttgtccagtgagtgcatggaagcctgtgaagtgaggcctttttaccctccctttcctggtcccctctccgtccctggcatctgaggatgctgctcaccggcttgttcttcctgtagctccttttcttttggtgtttattgctccttttggctctcctcgtcccaagatgtgaggattctccagcctttagtcctttggtgcaatgttttcctttgtttttctgcctctcctttttctccttggagatcgcactcaagactcttgagacttcacatatcacagttgatcaaatgttatctctaggcctgaatagcagcctgggcattcaatctttggtaagtataaagtaggacaagtgacttgaaggtcactctgactctaaaattctgatatcttctgatgtttgagcttctttgtctgacttagtaaggtgcccgaagatagaaggcgtgtccacatgcatttcctcaattatcgactcatgtttcttctgttttatgactgcatttgacctgctggttgcgggcgtccctctttgtctcagtcttactcatcaaattaatcatgctgcttctggatacagtggctaaaccttgccctgttgaacctaatatcagggacagtgtgccgtgagatgggctttactacgttgctggacactttcacttggaaattaaattaacctgcctccgtatactttctatcccaaagctattttttctcctaagttccctaggaagtcctctcaccccccttctatgttttcagctcttacctatcctatcctgaactcttagcataagtccctgcttctggaagaatattcatctctctgtccatctgtgcattcagaaatgcattcattaattcattgactcaagatgtatttactgagtgttcactaagcattataggcattgaggatatcatgattgaagcagactggtttctactctcagagcttttgttggtggaatcaaaagacaaacaagcaatttcaatatggattgggatgttctaagtcagggaatagtaattttcccacacatcctgagtttctgccacttacattttcaaacctttgcctgttttaaagacaggattgataaagacacagtaaggtcaagacacacaagattgtaggctgaagaagtgcttccttggaaagacttcacaatagctcttatttatatgagtattggtataggcttatatagagaaaatatgggagatttctcagagatggactgtgttataaatagaacaaatcagtcaaattacagctttcaagccacaggcctcattagtctcatgagcagggccctttgtgggcaaactgaatgagccacgtggaataacactcgtgttcatgttttgcaagctcaacatgtcaaactgtagtgttaaaatgagttgctttacaaatgagctataaatattagttctgcatctccaagccattcaatatgcaattgtgaaaactgatatccttataacttatgtataagtcacatatataacttatacacatatacataacttcaatgtacgagtgagtaaaaagtacggcattagtcagtttgagttgctgtacaagatacccattcattaattcattgactcaagatgtatttactgagtgttcactaagcatcataggcattgaggatatcatgattgaggcagactggtttctactatcagagctttggttggtggaaacaaaagacaaacaagcactttcaatatggtttgggatgttctaagggaacatgtagaagcaacaggctaagattcagaaacatttctctccaaatgggaagttttctaacacaaacacccaacttaagaacaaagaggcaacctctcatccaaaaacatctgcccctcacattgctttcaatatgcaataccttaaaattccacaatgagtattttcccaaaacaaagaatagaccctccacaggaaaactcaagtctcttccttaggagactgggtgacttaaacaacagatgttcattttctcagttctgaaaactggaagtccaagatgaaaccagctttgccagccaggttggtgtctcgttggggcctcccttcctggctcttagagagccacctttccactgatcctcacgtggcctctctgggcattgggggtgcaggaagggaggcgagctttagagagctctggtgtctcttccgcttcttataaggacccctgtcctcttgtgttagagacaccgcatgatctcatttaacctgagtcacttccttaagggccctgtcttcaaatacagtcacaatacaggttagggctttaacatagtaatttttttacagctcagtccataacgacttacacatttcttattcctattgcattttctttcctaaagtacagtatttctctagatcagaagacccgactagacatttgtggcctggatttgctccttgtgttttatttagcccacacaataccttaaaaatacatgagccaatatttaacagctgggagaacattttccagcttctcttaaaatatgtggccatgctaggacccctttccccagtttaaacagtctgtgcattctcctaaggaagagacttgagttttcctgtggagggctctattctttgttttgggaaaatactcactgtggaatcttaagatattgcattttgaaagcaactctaggggcagatgtttttggatgagaggttgcctcttcgttcttgaggtaagttgggtgtttgtgttagaaaacttcccatttggagagaaatgtttctgaatcttggcctgttgcttctacattagctggctctggaagcatttgaggtatgacccatgatccaataggagttgctgtgatgatggaaatgttctctatttttacatggagctattgaatacttgaaatgttactgttgtgactgaggaagtgaatttataatttaatttaaacttttttattttggtaacctcatgtggctggatgctactgtattgagcaggacagttttataaaaatgcatagcattttgcatacaaaagggattcctagtcaaactggccacatgacccatcattgagctttattcgctcctggagtgatctaacagtggtaagagcttgtcctgaccaggaagacttggactcccaggtccccttgagagcccttgcacatatgagcaggatacctccctgtattttgtatactgaagatccatggttggggagccctgtgtgctgggagacactcccttagcaagtatagccgcttagtcatttgccaggctgttgcattgcatgcattcatggtctatagtagtctgtattaatgagaccccgaagagatggttggtacatagcctgcatggctgtacacagcaatccggattaattcatcagttatgcccggtgccaggcacggaagttagggaagtcaagggtgagatggtcatctagatgggtgactaaagcgaaagtacctgagccacggttgagagaagcacagtttgctctggaaaacccagcatggggcacccagacacatcagtgggaattggaaggtttcccctgagagacgatgtttaactgagacctaaaggttgagtaagaggcagtcagctgaggcattgggaagaggtcatcctggcaaaggggagcacaaggctggagtcagcaggtgcctctctgttcacagacttgcagctcacctgctactgtagatagaaacaaagccctgcttggcagagggtgcaaacagaactgtctatgaccagcctctggaagttcagggttccacataaacactgatggtccggtgttgccagcccccgtccctgaacacagcgatctgagggagctgatgggatgctgctctcaactggggcatcacctcatcctgctcaggtctcagcagttccaagctgtgtccctcactaggagaccatgcagtgggtgtcgatcaaaatgtttgcactcttgtctttcttatagtagagaaatcctttaatataaccaagtctctatcaaaaacagggaaatataagttagacaatgaaggaggagagtgtctctgactgccccatcaagttattgatgttacctatctgctcgggccctgaaggcattcgtttgggcagaggcacgtcctgtctgctccctacaaatagatggtgttcatctagagcagggatcttcacgtcaggcctcagtgactccaggggatattcagcagtggatggttctcagggaatccacatcctccatttccatgtgtactctttcctgggatggatccgcctgagaacacgcctggggtcttccctctcagctgtcctttcacgcttgcttttctccctccttgcaagggaaaggcattcctcccagcaaaccctcctcttccttgttgcattgctctggcctgtagaaccctttgctttccagacagaggagaatttcaaacattagggtcggtattgagaaagtggatggctttaataagtgggtaagaaatccccttgcgagccagagagcttagaattcttggttttcaagagaattgaaggtgaacccaatcaagttgtcagccaatagatcattaaaaataatgtttgatgataaatcactgagtgacgatgggcataacagaatgctgtcgaggaattgggtgaaattgttaaaactgttaaaactccttccttcccatctgtttatttatgaaaataagttttctccatgcatacatttataaaaacaaaaaaatagaaataaaattgatgctgaacactttttcaatttacctagaagtaatatccatccatgaatatatgaactaattaaaaaaagaacattcccatttatctcattgagatgtatttccagtaaattttacttttcttattcaataattatttgtcacaatgtataatgatgtgtgatggtttgattaattgtgaatagcaattatgatggataatcaaaccagtttttttaacatttagttttagagtcacaggaaattttaaaaattattgtaatatctgtctttttgctataaagaagtgtagtacagtgataaagctttcaagcttaatatatattacatcaaataaaactctgaattgaaggagaagaaggaatgatgtaaaatttgcagttgttaaaaaggagatttttaaatggtcattggtaggtatcaaatcaaagtggtctctgggtccctccgtatgatagaaaagagtgacctaaaattttacagtacactagaaattaaaacacttaaatgtaaacttaaaatatgtgagagggacatcgtttttcaaaatttttatggagtacctgggcaaaaatatctgaaggccatgttcagtgaaagtggtaataagaggcatatgcgtaattttaaaccaaaagttgaaacagagtgggaggagcggaagaggagggggagaagagaacatgttgggccaatatatttaacaataatcatcaagaaataggaaaagacaaaacaaaaatcttttaaatatctaacactgttttttctaatgctacatgcccatgaaaatcacctgggctgggtcaggactttgttttagtcctcaggtgattttaatacacagccagggttgtgaattatcggactaaactcacagagtggtccttgggctagtactatcagcatcatcctgggaacttgttagaaatgcagaatttggggctccatgtcagccctcctgaatcaaatcctgcatcttaacaagatatttaggtgattcatatgcacgttaaagttttaaaaaaccaagatttccaacaagctcccaggtgatgctgatactgcggttcacggacaactctggtcacggactacgctgggtagcagagttctcgagttgtgctactcagaaggtttatggcagagctactcgcagtatgatccgagaatcgcgagcctcgcctgacttggattcacattagacatgaaaagtcttaggacccatgccagacctagggatcgggacctctgggagtggggtccaggaatctgtgttttatcaagctctccctcactaaaatttgagaaggaccaccctagagagaatccacatcgacttcagatggctctgagcctccagttaatttagggagtggctggggatgtgttattaccaagaggccccacttcatgagagagctgctgcatgtgatgagctccctcatcacagcctcacttgtctccaatcccagggatgcccgttttgcagtgggtctcgaatgtgtgaccagttttacacaggagtgagctgacggtgccttgcctctttcctcgtaccacatgcatgtacagcccttgggcactgcacctacccatgtatcaggtgatccagaaggctgttagtgttgaggggggccgagacccagagagggctgtcaggtggatccaaggacaacttcgcagctgtttgcattgtttgatccagcagaacggatggtgctggaggcatcctttggataatgattctgtgtgagtcagtgcaagccccgttgcagagttgcagctcagggcccaggagttctggagcaaaaccatttgcttggcagcacagaactgcgtattatttgagaaggactaacatcttgcgctaatgagtttctgggccccagtagacactgagctccaggtggctagaaccagaactgcccaccttaggtcaagtattatcagattatttttttctctttttctttttttttttgagacggagttttgctctgtcacccaggctagagtgcagtggcgcaatctcggctcactgcaaccttcgcctcctgggttcaagcgattcttctcagcctcccaagtagctgggattataggtgcccgccaccatgcctggctaatttttgtattcttaatagagatggggtttcactatgttggtcaggctggtctcgaactcctgacctcaggtgatccacctacctcagcctcccaaagtgctggaattgcaagagtgagccactgcaccaggtgttatcagattctccaagtcataaggatggccagatgcaagaccgacccattgggtggtggaaataaagaagcaaattacatgacaggtggcctcagactactctgatgtcacccacctctttagtactgacacctctcctccacctccatggctgtagcctcaggggtaagggatccttttaaccagctggcaggaaactaaaaacttgggactaactcacagatgggtcagaatgacatgttggtggcagctaaaaatgtagttgttcaatactgtccttcccagggctggcctgaatcaccaggggtaatggaagtcccttcagtgggcagagatgtgagcagtacttgcaccaccatccccactggcccagttgtggagttatccttcctctccccagaccttaagctctgctgtgttagagtcctgcatcccgggagatgatgcctccactggagaatacccaagggtgccctggaccaacagtcaaagaagtcaccgtactggcctgggtactgggtcactgtgctggtatgggtagtggatcactgtattggcatgggtactgggtcactgtgctggcgtgggtactgggtcactgtactggcatgggtactaggtcgctgtactggcatggtgaattggtgccagtgaccacgaggtgcctgggttgctgctatacagtggagcagaagaaatctgtctggaacccaggtgactcgccaggtgtcccatggtgctcccacactggtatactgtcagtggacagttgtgacgaacaatcgtgagtccactaaacactttaagaagggtctggggtaccatgacaccagcaccctagaccagctaaaatgctggctaagagtgggagggttgtgctccttttctccctcacttcttcttcacgggaattccgcttcctgataatgctgaacccaggctagggcagagctatctgaatctgtagagcaaagagaagacagtgtctccacagagtcaagacatttactatgacatctgtggctccagcgttcaccacaatggtctctttaggaaaggattcccagaagaacatgtatcggccaaggagaagacggtggctcaacgcacattctcatttggcgaaagtgcattgaacaactgcctaacgcccgtcagtccgtctggacttaggaaaacccatgtgtaatgaagagcctgtggccgcttagcattagaggaatgtcagcggctcagggcagcacagctctttctcggggccctgatttatggaaccctgggctttgctgaactcacaggcatggacaccaatcttaagctgtagcatgaagcctcgtggtaactcaaaagggaaaacaagaaccactttcctcaactgtttgtaaacttatattagcttcagaattctgcataacgtagactcacatggctttgtctatgtgagtgggatttgaagccaagttgaatctcctggcttcggattctctattttgtaactgcagatgggatatgatttattaactttgtcgctagctatttgaaaaaggagctcttactatggagaagaaattgttacattcctatcacccgcaaaataggacttgactctttcttcctcaaattaactaaagtcaacctgttttcaattggtgatattccttcattagttttaattcatttttcagcacacctgattttttaattcattatgcttttgatggaaattaattagtttcttttagatctaaaacaatattattgtgggcactcagacattgttacacaaaagggccttattatgaagctggtctcagaatgaaagcctgggtctgtttcataggaaactcgcctgacgatgaagccatcgggacgctgaggctttttggctgcctggttctgagcctcagttttcccatctgtgaaatgaggagcttgagccagatgaactctaaacttttgtttgatgagcacaacaaaatgaaataaaatcttataaaatagatatatgaagatgtatatgaaggtttatggtaatattatgttgatcaaacattttcttagcccaatagagaatgaaaattaatatcctactacaactttgcagaaatcctatttatttatttattagacagagtctcaccgtgttgcccaggctggagtacagtggtgtgatctctactcactgcaacctccacctcccgggttcaagtgattctcctgcctcagcttctcaagtagctgggattacaggtgctcaccaccatgcccagctgatttttgtatttttagttgaggtggaatttcaccacgttggccagactggtcttgagctcctgacctcaggtgatctgcccacctcagcctcccaaaatgctgggattacaggccatgagccaccgcccctggcccagtttaataattttagaccgtattgccaattatttaaaggagaagggtgagtttgtatttctttaattaggtttaggtaacggcctagggaaaacgggaattgcttacacagacaggtgaggaggagagtactccatcagacccaccctaaattgaattaagactcaggacccttgatgtgctcagctggatgggccttggatgtgctagcctggctcccagggaactgtcgagctgggcacccacagtgttgctcatctgccccagatggacaactgcctgtaatttaatgtcttttccaacagggagctatgaaactgaattttactacaccaaagaaaaacccgcttccctaactataatttcaacaaggaagagtttacacagaaaaatcccatttaaaaagtgccacttaatgtaatacagacagcagctctccagcccgagtgccacacagagaacctcactgtttgcccaaggccttggagacagaagtcagacctgtgagcctctcgtgctgctgattcagcctgattaaacaagagccctaatttttatcaaatgtgcagtttggtattcacaatcctttatgagtagaacctcctgaattaatcaaacgactggttaccaaataaaatttttttcaagaaaagagcttatgacatcatactttattagctaggatgtatgtttcatcagaacatctgtcatcacacaagagacagagaatggactacctgaaaaatctacgcttaactacctggagcagagaggcaaagtgggtcagctgcccaaaggtgcagcttcggagagcggaggtcgcgagagccaggttggcggggagggatgctgggtggtgaggctgggccacttcagcctggagggtgagggcagagccaaaatcttaattgtaggttgttaaccaaacccattgaaagagaggccaggtgcggtggctcacaccttcccagcactttgagaagcccaggtgggtggatcacaaggtcaggagttcaagactagcctgaccagcatggggaaaccctgtctctactaaaaatacaaaacttagctgggcgtggtggtgcatgcctgtaatcccagctacttaggaggcagaggcaggagaatcgcttgaacccgggtggcagaggttgcagtgagccgagatcgcgccactgcactccagcctggtgacagagtgagactccgtctcaaaaaaaaaaaaaaaaaaaaaaaaggccctagagaaaagagcaagatgtggagtggccaggcctgaaatttgggtacgttaggcaggccagcgagactggaaaccaggtaacaaaagtgccctaaaagccactcttggctcagggtctcttcagcagtgggctccctttagcattcagagagaattctctccacgtgcttctccttttttttttttttaaacaaatgcagcctagtcaattaaaaagaaattccatttgcagtgtttatttaacactgaacaggttgcttgctgtatgaaaccaaaataataaaagtaaaataaaatttgagtgaataaattactggtacatttagaaagcggatgaattggcagcataaacagattgaaactgtggtttctagaataaattcagtagaaatgaaatttgatttgagctgctctgctacctacaactttgcagaaatcccatttaataattttagaccgtattcccaattatttgatgcagaagggtgagtttgtatttcttgataacacatatgtatttctgtttgaagtaaatgagagtaacttgcacataccagaaggaaagtgcgtcccaggaattttattaactatatgtttaggttgctgagaaatgacattctctcttaatttcatgaactgagtagtaaaagagctcactggggatgtgtgcccaacacatgcatgtacacacacacacaggcaaggaaaaatgtgctggcatatccttttgggtatgcagttaatatactgtttaaagggatctcaataaagatttcctataaattatgtttattgcatgaaaataagtagagtctaaggtgtgcattctaaatgtgcttggggaattccagcctttgattttaaaaggagaaggacatttgtttaaggaatttgattatctactgataggtcatttctgaaaagaatatggcacattcatcttggatcccagtggaggctttactgcggactgccttccccaaggccctgctccctgcacacctcactctcaacagcctcctggttctttgcgaaaaggaagccatccaccactctataaatcctctctaaacatatgtatgtggactcattcttatttacctccctcctgtcctaaagagtattactgcttccgttgaaggctaaaatttcccccacttctctgaactcatcttttccacaagcttggctctgttcttgcctttatctggaaccctgtgagcacactcagcacatttcctagacagccgtgtctttacccctggttcctatcaggagatccccttctcctcccgctacgaggggcagcagcagccctctcccctctccacgaccctctttagtctggctgctgcttgtcaggtccgcactggaactgcccccagcaggtgaaaggtgacctgtccatctccacctgtagaggtctatgttggtcctcatcaccttggccctactgcgcggctggctgtccccagtgccaccccagtgttctcaggttttctagtctctgacagctgccgcttagtgtaatcacgcttctttttttttttgctttcccattaagcattgttcttgtggagagctgcaatgcctccagctcttctctgttcatgcctctcacgtacacctgaaacctccaaaccctgcctttgcgatttcaacctttactcctggaactcacatgtgtgccctgctgtctagatgccccatggactcctcgatgtaccatcgacttcatcaagttcattatttcttgcccagaccagttcctctgtcactatcgacttggtcgccataaacctagaaatcctgggatggtcttaaattctttccttcttccattaaatggccagattttcctgattctatttctaaaaataattgtaatttatttagtatttaccgaggcctttaacaagctatgctgaggcagctgtctgacagaggagactccttatggccatggccacaagagtagtaagtgacagaaggaggattggaagcaagcgtgtgggattgcaaagccggccttcctcctcttgcctgcttctcacgctggtctttgttgacgctgtcatgctctcattatctctcactggattaatgctctcagatgtttttgctactgtttatcctaaaggaatttttgaaagccgtgtgtccccttgcacattttaaaaaggatattaaattcattttgtacctgcaaatagttgcaaggaatatttactgtaagtaatcacattttaaaacaaaaccatgacatcattcttctgaatggagcaactagaatatcccttagatgacaccattttctatttcaaaagtatgtggaaaacattttctttgacagttggaggtggtgctgatacactattgcactccgctgcacccctcccagaattagaccctaatataatgttcttttatgcttgaaaaacagttattaatcatactatcgtactttcctgcaacatacgtatcacatctacccatacacacatgtgcatatgtgcacaagcacatacacatacaaaccgtatttgaaatgtgcttatttccagtgaccataaacttaaaaaacaaattccatctcgagctgttatgatgatagttcttatgacacagttgatcaggattctataatatattacaaacttcataaataattattaaacctataaaatgttaattggaaacgcatctcttaacgagatggattcaggggcatttatgttttggggtcctgatgaaaggaattccagttgttcctttgttttggtacccagaaggatgttattttaaaaatcccttatcggaactctccaagcatcttcagcacttttcctgacagtcctgtcttccttacgtccttcagatgcaggatgacaggagccttctcttgttaaagtaggaggagggtgatcgtgaaagggaagttgagagggagtagctggagtcaggcaggcttcttgagcaggcagctttcagaaggaggacgcatggaaggtggatatctactaatagaagttgattcccttaaaactgcctgtgtttgaaaagttcatagagtacacacttagccccaggggaacagggaacatagaagaccaccacccaggccacgttctgcaatgactatagagttgtcttttcttttttttttttctgagacagtgtattgctcttgtcactcaggctggagtgcagtggcgcgatcacggctcactgcaacctccgcctcccgagttcaagcaattctcctgcctcagcttcccgagtagctgggattacaggcgtgcgtcaccatgcctagcaaatttttgtatttttagtagagacagggtttcgccatgttgaccaggctggtctcgaactcctgaccttatgatccgcccacctcggcctcccaaagtgccgggattacaggcgtgagccgccgcgcccggcctggagttttcttttctaaatatgccacttctcttcttccggacccccttgaggcccagcgcatcagatcttcacttcctggcctggtatttaagacttttcatacccgtcctttctctgtttagagtttccatttgccgtccgaactttccctttcaaaggtttccttttctctccaaatgaatgcacccctcctctgctggactgttcttgaacaaatcccctggcctggaatgcgcttgtactacatgtcttcaggatgctccagcatcatgtcttccccggagatgcacccactcctggctcattcactctttatcttcaccactcagcgttgctgctcctgccctgcctgctgaggtctgagctcctttcctggcaacactcccctttcgaccttgtatccttgagtagtgcaaagcccaggacacagagtttagaatggaatttgtatagtttctaatggcaagaaattagacttcctggacatttgtgggaacatggatttattagtctttaggaaggtaatttttaaggaaaatttgtttaaccacttcagtatatgttcaatggttgagagggtaatttttgacttcagagaatattacaaggaaataccatgaatttggaagatcctgtgagccttattctgactagtgaatttcaatttagagcaggccagagaattcattttgatggatgattcttagagggcggcgtattttgataatagattggaatgttgctgatagctggccattgcctgtgttacaacaagtagtcttttagttagcaggatcatttgtttattttcttgttactgtacctatctgtgtaacttaggtctttcttaaaaaagctgttccaaagctcacgtggagagtttgtgatagaagagttgacagacctttagttatgaaggcagtgcttggcctcacaataaaatattagcttggctggagagagaattcagaagtttggaagaataatatgtattttcataagtcgaaatgaccaatcattcacaagttgagaaaggacttaaggctcagtagagtttcttggagttatgtaacatcagtcaaaacttggaggatgtaggcttctatacttacaaggtattttcttccacattgctgtcctgtgacaaaagccaggtaggagaatgaagagcacctgccctgggaatggacccaccccccttcgagtctggccctgccactcatcaggcacatggctttggcaagctaagaagccttcttctctgcatccaatcctcatctgtcaaaggggacagcaatgctatgtatctcatgagaacatttaaagtactaagtaaatatatggaaagcatgtgtaacgttgcttggcatggagtaaggggtgacttattttactcttttctggaatgaaaataagatgccttttacactgttggtgggactgtaaactagttcagccattgtggaagacaatgcggcgatccctcaaggatctagaactagaaataccatttgacctagctatcccattactgggtatatacccaaatgattataaatcatgctgctataaagacacatgcacacgtatgtttattgcagcactattcacaatagcaaagacttggaaccaacccaaatgtccatcagtgatagactgcattaagaaaatgtggcacatatacaccatggaatactatgcggccataaaaaaggatgcgttcatgtcttttgtagggacatggatgaagctggaaaccatcattctcagcaaactatcgcaagaacaaaaaaaccaaacaccgcatgttctcactcataggtgggaattgaacaatgagaacacttggacacaggaaggggaacatcacacaccggggcctgttgtggggtagggggaggggggagggaaagaattaagagatatacctaatgtaaatgacgacttaataggtgcagaacaccaacatggcacatgtatacatatgtaacaaacctgcacgttgtgcaagtgtaccctagaacttaaagtataacaaaaaaaaaagaagacaccttttattatttctaagcatcctctgagttcttgaccaaacctgatggtgcaactaaataaaccccgtgcatgcatgattagtaattcaaaattataccctacgtgttggcattttcacttgttggagtgaaaattatcattttattaaaattcacttaaagcttgttgaaagcaggcagagatgctatctgccccaaataataagcttttagagacaatgtctttcttgaagacatgatatagtcttttttaattgaattatttggcgttattaacattttaatgaaggaattattctattttcatatttcttagaaactaatatttaatttcctttttatgttaataatataagtatttagcatatttaaaatctcagttaaaactaatttatacttatattttcataaagatagaagcgtaatatgcttctttgcattgcgtgtttatgttcttgctttgtccaagttttcccttttccttagctatattttgaaaataccagtctcaagggaataataattgagatcagtaatatcttggatgaaaaagcttgccaatcatgccggtgttatgaggatgtgtatttttaagaggagacttactaagtaagattcactggcattgggcggcttgatatatgtgatttatgggaacacctttcagtaattttacacagtccaccagaaaaccttcctcataggtagaaatgaggttgaacccagaagaaacggcctttggaaaagaattggacattgaagctaagcggctaaatagcttcagacatccctagaggaagaaaaataagatttaaagtgttattattaaagaatatgatctataaataaaatggtatattctcatacccctgacagattttgacaaataagagaaaaatgtgtgcttaataggaaaaatgtgtttgaagtatgttttacactatttaatgccgctggtgcactgagaggttgctggtggacttgatgttgagttaatcttggtgaacaaatagagaaggaaggattgcttggcgctggaggtctgctttgtgcagagcagctttgttgacagtcaaattagaggaccggcctcagtgccagttctcagcacctcgcggataatgagctttggacgagagtgtgggtctaggcttttttttttttttaacttgagattctttaaatcattttgaaattttgattttaaaaatagttctggctaatattccgtagaagtatagaaaactggccagccgagagcgacggatggcaccaggcctttgaagggtagcttgtgtgtttggaagatatgtgctgcattgctgtgggtaccgtgctgtcactagccatcaccactgccaacacatcagtttcacgagtcttgcaaaaaatgagatttaaaagtttatttaaatctcatttatttaaaagtttttttttggccgggcacggtggctcacacctgtaatcccagcactttgggaggccgaggcgggcggatcacgaggtcaggagattgagaccatcctggctaacacggtgaaaccccgtctctactaaaaaatacaaaaaaaaattagccgggcttggtggcgggcacctgtagtcccagctactcgggaggctgaggcaggagaatggcgggaacccgggaggcagaggttgcagtgagccgagatcgcgccactgcactccagcctgggagacagagcaagactccgtctcaaaaaaaaaaaaaaaaaaaaaaaaaatttttttccttgaaatttgcttttaaaaacatgccatttcaggaaagaaaaatatgtttctttattctttaaattcttaaattccatgtacttttgccataatagtcacccacccccagagtttttctgagagaatcatctcatatgggtgcagaatgttaccttatggtcaaactaattagctctgttttcctacctgaccgtgtggataagggagcatttgtcatttggatgatgctcagtgtatatagtcatccctccattccaggacccctgcatgaaccaaaacccacacgtgggaaaagttagttctccacgtacgcaggcttcacatcctgtgaatactgtattttcaatccacacttggttgaaaaaaaaaaatgtgcatagaaatggacccatattgtttaagggtcatctgtacattgactttccattgcaaagatggaaagtaacctattgctcagcctcgacttggacatggtttgtagtcctaagtggattctggagttcatttagtaaacaattttggagggcatctattaagtaccagctgctggcaatatagccataaacataactgtcctcaaggatgtcacaatccaatctggcctgtgttttaaaattattgtgtgtgtgtgtgtatgtgtttaatcaagtgattttaatattaaaaactctgttagaaaattttataattaaattttatatatatgcatttgtatgcattaaaataagagttgtatatcccttattcaaaattcttgggaccagaagtgtttccagtctcagatttttttggattttggaatatttgcagaatacataccagttgagcacccctaatctggaaatccaaaatcccaaatctgagatgccccagtgagctttcctttgagcatcacgttggtgctcaaaaagctttggattttggtctggcacagtggctcaggtctgtaatcccagcactctgggaggctgaggtgggcaattcacgaggtcaagacattgagaccatcctggccaacatggtgaaacctcctctctactaaaaatacaaaaattagctaggcttggtggcgcacccctgtagtcccagctactcgagaagctgaggcaggagaattgcttgaactcgagaggcaaatgttggagtgagccgagattgcaccactgcactccagcctgtcaacagagcaagactccgtctcaaaaaaaaaattttttttggatttcagagcattttttgatttttagattagggatgctcaacctgtatttttttaaaatgctttacacatttttaaatttgagagtatggaataggggttataacttctagagacaggatacttgagaaggatattatagatcttactttcttagaaaacttttaggagccaaaggttatgtacggtgtggtagaggaaccatagaggttttgaaatcatctgacttcagttcatatctcaactctgttccttcctagttttgtgactgagagaagactacctaagctctgcagaccttagatgccttatctgaaaatataaataattaatgtaacaatacataccttatagagtatgtgtgcagattaaatcagataatgtaactcctgcaacacagtagatgcttgctaaatgttaatgattgccccctgtctcatttccttacctgaaatctcaatactaattactggtgtttgttgttgagtgctaaaggtgatctgattagtatagggtcacagagcaaccatattccgtaatgccaacacgaagatctttcaatgagaatgaaatgcaatttttatatttttattcatgaaattttagagtcacataactacacttgaatgcctttgttcatgagaaaacatagaagtgacaatttagtatttctctgcaatatcttctgtaaacattgaaagaatatttgagggattttcgatcagatgtcagactgaagtaccttctgcagccactccttctcactccaaataatagaaacaacaaaaaagataggtacatagataacagaaaagatgggaagggatgtattatgaggaatcgctatagagaacagacaaagttggattgaaaagaaacctacaaaagatgggacgaacactagagttaggagacactgagagcagggtggacccaggtgcacatgcagggtggctcagtgaactctaactgcttcatctacagtgtcctccagaccctgtacgtcctaatccagccctgctgtggccacagatttgcctgcccacttgtgacagctatcagtatcaggacttaggcctaagagagaggtcacttttctagtgagctgggaggacagaagagcccttcactcccagaagatgatctagataagatcctcaagagcacatccaggtccttctctcactgcaggggatagacacagcagatattcttacctggaatctcaaatagaaagatgagcaccacaccaagaatcactagacagctggggaatgacaacaccatgaaagagagacacccactcaacaaaaaatacttatgcaaggaaatgctgaatagaacaagcagaagagaactacagaaaaggtacatttactattttaggagaggtgcaagaacatattgcatccattagaaatggatgaacctgtaaattaaacattgattgttgcaataaaaattaaacaggctgaagacaaaagtgaattcaacttgagaacaagcttagaaattctcctaggatgtatcaacagaagactaggagaaataatgtatgtaaaaaaaagttaatggacatagaagatagagccagcagtgccaatattcatcaaatgacaggagtttcataataagggaatgtgggggaggtaatgtacaaagaagccctaggcaattttccatagctgcagaaaggcaaagaggccattaggtgccaataaaagagaaacaaacaaaaaacttacaacacaatatactaaaagatcctggggtggatgtggaggctcttttagtcaaagttctgaggggaaaacttaagaatgtggaaatctgtgctgcctttcaagggtcaaaatgaagtgaagactataagactttttcagacattcacagtctctaaagcttcaattaatgaatggtgaaagaattaataaatgatgtactccagcagtaaaaaagctgcataaaaatgaataataaagaatttactgaaacttactgttaaatctaaatgtttattattgatagcattaatacagaactaacattccaagagttatcaaccagagattttggaagactggggagaagagagatgtggagtaagggaggaataaagaaaatgcatactaattttcttatcttgctcaagggaaggatatgcttattgattcagtctagatacaaggaaaaagtaagtttctgtaaatgttaaaaatttaagggtagctagtagaagaatagaaactgaattcatgacttccaaactactggagaaaaaaataatgtaaatctgatcaagaaaatatatgaaaagagggtttaaaaaatgaaacaacctagaattttggcaaaataagtgcataaaatatcaggtagttcaaatagattaataatctcagtaaatgtgactaattttgactaacaagactaacttcaacccaactctaaaggacagagcctttcaggtaatgttaaaaaaaaaaaaaaaaaaaaagcagctggccgggcatggtggctcacgcttgcaatcccagtactttgggaggccgaggcaggtggatcacctgagatcaggagttcaagaccagcctggccaacatggtgaaaccccatgtctcctaaaagtacaaaaattagccaggcatggtggcgggcacctgtaatcccagctagtcaggaggctgaggcaggagtgtcgcttgaacatgggaggcggagattgcagtgagccgagatcacaccactgcactctagcctgggcaacaagagcgaaactccacctcgaaaaacagctatgttatatgctacttataggatataaattttttaattgcatagtatgaaaacatgtcaaacattaaccatgttgattaggttgagcaacattaatataagaaaacttagaattcaaggtaaacagtgttaaaagggacaaagagggatatttcctgctgaaaaggaaggctctaccaagaaattacaaggcataatcagtataccataaccaagtagattgaatccccgaaaatgtaaggatggttcagaattacactatgaaaaaatcaactcctattaactgaaaaaaattactcttagtcacctgggtatagagggaaaacttatctaaatagaggaaatctaacaaaaatctactggaaacaacatactgataaattattagaagcattaagtttgaagtctgaatctggggaaagatgtctactattaacattgtactcaggacacagtcagtgcagcaggacaaaatggaaggggaaggaggaggagaaaggggaaaaagaaactgaaaagaaaaaggtatagatattagaaaaagagcaaactgtcattatttcaggcaatatgattacttgcgtagaaaacctaagacaggctgggtgtgacggctcacacctgtaatcccagcactttgggaggacatggcagggggattgtttgtgcccaggagttcaagaccagccttggcaacatggtgagaccccatttctacaaaaaataataaaagaaattaaccacgtgtggtggtgcatgcctgtagttccagcttcttgagaggttgaggtgggaggattgcttgaggccagaaggtcaaggctgcagtgatctatgatggcaccactgcactccagcctggccgacagagtaagaccctgtctcaaaaaaaaaaaatgaaagaaaacctaagataataaactgaatattaggattaatgagagttctgaagggtggctagatagaagatagatatggaaaaattctttttcctgttcatcaggaataagagaaatttaatagaaatacagtaaaataggaacataccattcactgtagcaagcaaagctattaaatatttttgaataaactgatcaagaaatagttaagaatctatagaactttaatgacgatttttaaaaggaacaaatagtgtgatataccatatacatggatggaaagactcaattatgtaaagttgtcacctctccccaaatctataaattcggtaaatcatgaaacttgtcaagatgattctgaagttaatatggaagccttaataatgaatggtttaaaccatagtatattcatgctatggaatacaatggattagttaaggataatgaggtaaatttgtacatatgagaatggctacacctccaagatacgtttttgtgtggtgaaaagagaaaattgctaaacagtacatataatatgatatcatttttttaaaaaaacacaaaagataagtcaggcaccgtggcacatgcctgtaatcccagctactcaggaggctaagagcgggaggattgctgagcccaggagttcaaaaccaccctgggccacatagtgagaccccatctcaaaaaaacaaaactgcaaaacaatactttatatattttattactacatgtatatacatctaagtgaattcaaaaaatacccaggaaaaaaaaatcacaagaagcttaacttcctttctggaaaggaaggatgaagactgaatgtagaaaaattttcaaaagggtatttgacccacctttccaagtcgtctatgtctgctttgtgtataagacccagggttttttgttgttgtgtagcagggggaatagggaatggtatatctgtaccatccttctaggaagcacaagtcccagtacaagctttaaaagtaagcaaaaaacgaaggaagaatttccctatcaggtgtcaaagtgtattgcaaacatcaactaataaatttgtgatactagaataagaatgagcaatagtgttgtttttggttatctagtataacagttgtcccaaaatttagttgtctaaaaccttgtatttttcttttttcttttttttttttttgagatagagtctcactctgtcacccaggctggagtgcagtggcgtgatctcggctcgctgcaagctccacccaccaggtccacggcattctcctgcctcagcctcccgagtagctgggaccacaggcgcccgccaccatgcccggctaattttttgtatttttagtagagacggggtttcactgtgttagccaggatggtctcgaactcctgacctcgtgatccgcccgcctcggcctcccaaagtgctgggattacaggcgtgagccaccaagcccggcccatatttttcttttgctcaagattttgtgggtcatgaattggaaaagggctcggcaggtgatggttgggggctcaactttgatccacctgcctagctgggaggctgggctggaggtctccttccaaggtagctcctcctggggggcctttgctcatggcttgaggctgtcattgcatgatggcatcagggtagttgcagttcttccatagtgaaatccacttatcaggcactttgaacttcagtaacagaaaacctcaactcacgctggttttggtttttttttcagtaaggtaattaaaagcaggctgtaggtgcccactgtggctcatgatgttgtaaagacctgagttttttctgtctttctgctctaccattctcagcattggcttcatcccaaaccaagatggcagctggcagcagtttggacatggtgcatcctgttacattatcaacagacaaagaaagtcaccccataaaaattccttctcttttgtcttataaggccaacttccattaccatccccaggggacagccagatgctcattggctgaaagtgattttcaggggttaagtcaacactgagttaccacactgcccaccacacctgtgtcactcacgtcacacttctccagatccattgcaaataggtgaaacatatacatgcaaaatacaaaactgtacatccttagaaaataatgacgtgtggggaagatcttttttaagaaacaaagttttaaagcaacaaaagaactgatagaaattttttttttttttgagacggagtcttactctgtcgcccaggctagagtgcagtggcatgatcttggctcactgcaagctccacctcccaggttcacgccattctcctgcctcagcctcccgagtagctgggactacaggtgcctgccaccactcctggctaagttttttgtatttttagtagggtcggggtttcaccaagttagccaggatggtctcactctcctgacctcgtgatccgcctgcctcagcctcccagagtgatagaaatattttattgcatcaaaatttaaaacctctatgtaacaaaggccctataacaaaattgagacaaaagacagactggaagaaaacatttgcaacatagtcaatctacaaagtctttttagaggtaatcactcgaaaaaagacaatgaaaaaaagatgggcaaaggatttgacaagaaggttgataggtgatgaatacatattgccagtaaatgcatgaaaagatggtcaagttgacttttcatctaggaaatccaaattaaggcaaactataaattttcactcaagttgtcaaacatttaagaagtttgataatatcaagtgttgagcagggtaaaaggataatggaattttcaaaatgcaattgatgtgtaaattaatacagccatttttgggagcaatttggtgatatctattgagaaaataacttttatttgagggatgtgagtccttttaaattatcaggcccagagagacattaaaatgacgtagcagtcatctcctcctctccccttggaggcctgtattcatctcttgaaactgctattttttgccacaagtagctataaattaacttgataatgccgcacctgacactgtaacccacaccctatagtttaacaatatgcagccaatcactaatcaatgtgattcctgtaaaccaatgagaattgctgaccaaaaaaacttgatcagcccactccctgtcccccactttttgcctttaaaaacctgcttgcaacaaaggccgaatgaagctcacatccaaggttaccggggtctcagtcttctgggcagctgtccccactttggctcaagtaaactgtctatattttgtgcctcagccacttccttttaggccgacacgattataatgatgaatgtccaagctctgtaacccttcagtctactgctgtgaaaaatagttgcacatgatcacagggagacacgcgtaagggtgtttgtcctcgtgtcaactggaaacagttgtaatgttcctgagaaggatgattaaagagcctattatgtagctaggatgcaatattatatgcaaaggtcagtgaagcgccgtgcaaaaagatcaggaaagacattgctgtcattttactctccactagttatttaagtcatctatgtatttgtttaagcaaaattcgcttgtagttccattcggtatctttaaagttgaagcatcttcttgcttgattgttttggtgcttgtaggagggtagtaatcactgtgcaggcatttttgggcttggggagtgcttgtgtgcttcaaactgaacagtttccactgaccccctgctgcttgggtgccaccaaaaataaatggaatgagtaatttgaacacaaatgggagaaagcacgactcatttccatactatggagaacttgaatgtcttcaccagaagggatgtctgttaacttggtgctcattcaaaaccttatttggggctaacacttctttataagctgtcttcatgagcctgaagtaattcaccaagattgatttgtaaaacattctgaatcaattaaggctttaatcagcaaagtagcaaacttcacatggcttgtggactaattttaccctctcccgtcaatgtgaacctaagttgaaaaaagaaaacaattaagaggatgtaattatctgtcctgattactgaattaaaagagtttgtgtttatctgtcccagtgtaaaggtggtaaacaatgccaggagctgtggcactccggagctcctacacaaaaacctgcagagcatcctagaagactctagtgaccctgccttaagtgacctggcagcaaacaaaggctgccgagtattattgtgtataaatgtttcccagagcacggtttgaaaaagctccttgccaatggtgggtgggggagtttcctgcagaaacatctcatttgaattactacatggacagatccatctacttacgcaatgcttaggaaattgctttcctttatttagaccagttctcagcagtggctgcatatttgaaccacatggcggagctttggaaagtcccagaaaacactcagaccaattacatcagaatgtctgggggaggaagcagggcgctagtaccttttcaagttccccaggtaatttctgtctgcagccaggattgacagatccctggttcagacagcatttccaggctggtgcagtctcggtctgtgttgttgtggcacagcgagcaaatcttgtgggaatagaatgatttttgacaatgtcttctttttggtaaagggtatgtgttaatgcataacataactaggataacttttgtaactttgtcagactttaatgtttatgcatcagaaagattcctttctcagataatgcttcctaattcctgagttggaaaaagtggttatctgaattatttgttaggcaaagcttgaatagtcagtgactttcacttagtctcttccttattttcacttcaaatgtcaggctttttaatacgtcaggctttttctgaaaaaaatttgagcttgagttactagtggtttatttgggacctctcttagttccatacttcagtgttccttagagcagccgtccccaacctttttggtaccagggagcagttttgtggaagacataaaacatttttcatggtgggtagggatggtttcagggtgttcaggcattagattctcataaggagcatgcaacccatatggatccctggcatgcacagttcacaatagggtttgtgctcctatgggaatccagtgccaccgctggctgatctgacaggagggggagctcaggcggtaatgctcactcaccagcagctcgcctcctgctgtgcatcccagttcctaagaggcctggaacccataccagtctgcggcctggagggtggggacccctgccttagaggatgagcagaggactgctggtgcaaaccctcagcctggttcctgtcctcctgagccattcacttctgttccaggctggattatctacttagcaagatgacccagactccttaaaggaacacagggaatgaatagtgttagccctgcttgcctcctgggttccttacctctcccaccaattgaattatcagagacctttccagtgagggaaattctgcctgaaacttttctccacttgtcagcatttccactgatgccttactgcccttttgagattggcaccccattgcctggctggcccattttattttaactgtggcaaaatatatatattgcataaatgttaccattttaactatgtttgcatgtacaacttcatgttattaagcacattcatattgttgcaccaccattaccaccatccatttccagaacttttccatcgtgccaaacagaaacgctgcactcattacaccataactcttcatcatcctccctcttcagcatcctcactctctctataacttttgttctactttctgtctctgaatgttcctactctgtgaaggtcatagaagcagaatgatacagtatgagtccttttatgactggcttctttcactcagtgcaatgtcttcagggttcatccatgttgtagcagttgtcagaattccttccctgttaaggctgaagaatattccatcgtacggatggaccccattggtttatccacttattccctgacgggcgcttgggttgtttctgccttttggctgttgtgaatctgctgctatgaacatgggtatacagatacttgttcgagtctgcttacagtttctttgggtatatacctgggagtggaattgctgggttgcatggtaagtcgatgtttagctttttggggacacatcatactgttttccacaatgatcacagtggtcacattcccatccacagtgcacacaggttccaattttttcatatccttgccagcacttaatttctgttttttgtttttgtttttgttttcataataaacattctacttagtacaaagaagtaggctggtctatttttcattcactgtgcctggaactggctcacttctaatatgtttacacatagaagaaaaattgtgtttatgtcaatttgggcagggatcaagtttacttctcttctccttacgtttcctattctgttctctttgtttttatagtcaatcatttttacatatcttttgctgtcattttaatggggctttgggagggaaagaaggtcgatatatgttgatagttgttgtgggcagagattcagtaaactgtcccttccctttcctgcctgacgtctccatctgttgaagaataagacaaaagggtaaagcagataggaagttaaaatattgtctttataactaatacacggatattagagatgtggctaatatctctgcaagaaagtaggtttccagacaacaaaaccagagctgaacttggccacccagtcttagacagccccaaggacgtgaggggcacagctgaccttggccgtccagtctcagacagccctggggatgtgaggggcagagttggtgtgcctcctgatctagcctgcttagtaacgggaaagaggaaggagccccagggaatacaccctgtttattgctcccaaattcaccaattagctcagtcacacttctttccccagtgagggaaagaatgagggagcagagaaagagggaatgacaatagtggatcactaataccagtagtgacgatagtgcattctctccacaaagaagaaaacagatgtgagtaagaagcattttcccccagcacaaatcctccatgtttaacagactgtcccatttgagcttgctctctgaccactggtctctcaggggtgctaactctgagcacatttcctatacgtttcttcagtctcctaccactcagacgtcttggctgtggcatgaggtccccgtgccctccagcacgttttactgacaggagtagaaaggaagggcatgtcatacccccatcttgggaagtgatgaacgtccacagagatgagattcataggaagccccatctgagccacagcagatggggcaggagggcccagggggctggaggttgtggaagcagggagtgtgggaggcctggtgatcctcctgaagaagtgagaatgggttggcctaaagggtgagttggtgggagaaaggagagaatgcagaagggcatttcatcccactccctttggagggatgtgggaatgtggagaggagtaagaccgacagactcaaaatgttttgacatgtgacacgccatttacaaatatgtatgctttgtaggcagaaatgaaagaatagccaccagatagaaaccaggtgtctattttccctgagttcttttattttgttttattttattttggagacaaggtctcgctctgtcgcccaggttggagtgcagtggtgtaatcacagctcaccgcagcttcaaactcctgggctcaagtgatcctcccacctcagcccctcaagtaactgggactacaggtgtgtaccaccacgtctggcttatttttttcttttttttttttttagaaatgaggtctcactgtgttgcccaggctggtctgaaactcctggcctcaagcctcccaaaacgctgggattacaggcatgagccactatgtctggcttcacctccattcttaacccatcagttttatggatttttcttctaaataacccaagatcactagcaccaacatcttttcagaagttattttgggctccacagggaaaagaagccctcgtagtcctacataaacacacttaaagtgtgtatttgaaaagcagagagagcagcagcggacctgctggtacacagatcagaaaggagatggggatgcgaaggatgagatgggattgaaaggaaaaggaggcagagtgacagaatacagaataaaacattatgaatatattttgttagttgactttttagctattttagaatacatgcataaagtcctttcagttcttgggaggctgaattctctcattcacaaccaccatattgagccttactttggtctcagatcacactgaagagctgattcacttatgcattcattacttcaataaatactgattgtgcatctctcactggagaggccccattccaggctcagggaattctaggacaaggagaacaaagatgaccctgctcttctgagctctgattccagtggggaaaggcaacaagcaagtcaacaagcacataactgtgatcattccagagagtgatctgtgctttgaacgatgaaagggggccaagtgattctctcagcagagagaacaagtacacaggccttaggaaggcgggacttttttgtgtgtagggaaagaaggccagaatagctgggttacagctcccaaggggagggcaggatgagatgatgaattttgaggagaggctctccagaacagtgcatgcacgcactagttttcatgcaattccacggaggtcgtggactcccctgcccctgcccataatccatggaccacagattaattgaaaagagagactgagcattgattgtgaggcatacagacaccaggctggttagagtggggaagtgtactgttcccagggcacaggaatggcatgctgtgtttagggatactggctgtggaggaaccacttgagaggaggcgtaaggacagactgtgaaggactttgatgtccaggctgaagagtttgaccttgaacccattagccatgggagctggactgccgagagaacacgtggcctccatccacagccctcagctcagtctccttggtaggccttaggctggtgaaatgcaccagctctgccatcctctgtccttctggcaggttaacaacaaagtggctcacatgtggaaataaacgtggctggtatgagtgggcgcaggccttcattccccgtgctaatggaaaagccgtatttttccaagtggtgctgtaaaagctaagaaaaattaagcttcaatcaaacacagaaaaagcttgattttaagttagattgaagtgaaattaaaattgaccttggccagttttgttctgaagagatgagttcaaactggccaaagaaaaaaataggcccctaacacaggagagagaaagagtggactcttcattgaaagcatgtttttctcaagcatgtgaagaaactagaatttgattattttggtgtgaaggtatataaaaatgcagcccttttgattaagccatttttaaaaacctaatgtattagtccattttcacgctgctgataaagacatacccgagactgggaagaaaaagaggtttaatggactcacagtgtcatatggctggggcggcctcacaatcatggtggaaggcaaggaggggccagtcacttcttacatgggtggctgcaggcaaagagagagagcttgtgcaggggagcttctctttataaaaccatcagatctcgtgagacttactcactatcacaacagcagcatgagaaagacctgcttccatgattcggttacctcccaccaggtccctcccacaatacatgggaattcaagatgagatttgggtggggacaaagccaaagcacatcacttaaaatatggtttttgatatctggcttattttctggctttggggtagtgtgcttgtttcttaaatcagaattttctttagaaataactatgttttatttcttcgctatcattccttgactatgcatggatctctgctgcatgaacatgttctttttttttcatggaagaaataaatatcatttctggcagaccatgacttatcctttctatctttctcgagatgatcagactccacagattgtgtaaaacttctcggaaaaaccctatttcataactcgagagtcatttttgtttgaatgtttcacggaatgttaatcctggcatatttggctgccatcatgaaggactgcagctgtgtggcgtggaaagttcaaaagaaatgacccaaaggaatgagtcataggtcagccttacaaattgggaagaaatataatcaggtaacctgtcatcacccactagaagtgttattatttattgtttattggtaaaaaataaacctgtcaccaatcattgattctgaaaaatgtgccgcttagtttattccaatgattggtacatgagctgggaggatttgtctcagggaagcactgtagttattaaataccatcaagcggacccttgatataatgaggttaaaactgtctgtgtggaggaactatactttattaaagaaggaataggaaaagaaagccaccttatcaaagtcagctttacagactaggtgacaactggttaatgaatttgctattttagttgaaaacataatttgcattactgttagacaaaatagatggggggcctttacaatcagataatgtaatctgctctagtattatggtccaaccctgttctttcatctataattttctcccacaataatgtattactattttaatactgcattctgccctgataaagtctagacttgcatcccaattccaaacgtcagcataaatgtacatatgcaccttttattgtgtgtcttcataaaccaagggcacttccaggggtacatctgttacctttaatttgcacacataggtccctgttcatgggctgctgtttataaaaaggggtttcattggcatcatttcagccttcagagtgagaaacattgaccctgcttgcttttgttacctaatattctgagctgaataaatgatgtgtacagtatcattgctccgtatgagaaaatgtaaatgactacattacattgttggaaggcagtaatacaaaagggaaatatgaagtcagccgacatttctcattcgggaaaaacaaagctgattctggtgattctgtgtgggagattgtactgggctgcaaagcgttgtcaattgaagatttttttttcccccaaaaaagaggaaactaacagtgtgctttttggcacagttgtatttttcatttcttttttttttttttttttttgaggcagggtctcactctgtcgcccaggctggagtgcagtgatgcaatctcggcccactgcaatctccacctcccgggttcaagcgattctcctgcctcagccttccgggtagatgggattacaggcgtccatcaccaggcccagctaatttttgtatttttagtggagacggggtttcaccatgttagccaggctggtctcaaactcctggcctcaggtgatctgcctgcctcggcctcccaaagtgctgggattacaggtgtgagccaccacgcctggcctgtatttttcattcctctaagatttcagtcaggtgtgcaagcccagagggaagcaggatagctgggcttcggggtcagctccaggcttcctgcagcggccaccctgtgcccccagcccgctgcgtcctcttcccagcagctcctcccctccctgcttgctcagcactcggcttccacaggccacatctatttttcttgcaaatcagaaaatgtgggtacagtgtttttaacttttgaaattttagattttgagatctcacctgacattgagagacactggctctctcaggcagtccactgcacatggagatgtcttactactcagcaaaaaggaggagggggctacagtgtacacttaaattaaaaaccaacctaacacgttgcttgcgaactttaacaaataatacattggttcctttggttcccacagggtaggaaaagaaaatgctgttgaaattattttatttgaaagaaatgccatgttgtatttattgtttcctcagtattgcaagttaaaaatctcatggatttatttaggatcatccatctaagtgcagtgcaaaaggttctgcataaatggagttctgtcattgcatcattaaaagtaaaaatgatcaaaataataaaaggcatttaaaaatgcatcattctttaatacaaagccttggtcagcattcagggaagtttatgtaaagctatataatattttgcttttaagactccataaagatgttataaactaggggccatagtttccatggatttttgatatattcaacttaattttttcattctataaatttattctaatatataaagtgattgctacttttcgttatttttacagcgacttggccccttttaagctgagggaactgaccttatgtgtcaatttccaggggaagatgatggccatcaggagtaaaaggagtgctcaataaggatgtaggtgttatactgaacaagaaggacttagcgggtgtcataattttaaagtaaatagtttttattcctgtctcccactgctccttcaagatgctctcgttatgctagtccttccctgaccttttgagggaagtctctagcaggtaccatttacctttttgtaaaaaagaaaaaaaaaagtaaacttttaattttaaataattttagatttacagaagagttgcaaagttagcacagaaggttcccatatacccttctttcagtttcctgtaacattaactttgtatataaccataataaatttatcaaaatgaacaaattaacattggtacattaccattaaccaaactacagagtttatgtagattttacccatttttccactaatgttttttgtctgttgcagtatccactccaaggcatcatgttgcatttagttgttttatgttcttagtcttctccaaaatgcataataacagtttctcatcccttccttgttttttatgaccttgatactttggaagggtactggtcagttattttgcagagattatttgattggtattgtattaaactatagatcaaattggacgaagttgacatcttcacaacattgatctaccagtccacgaacatgctgtacctctctgtttatttcggtcatctgatctttttcatcagcattttgtagtgtttagcagatagatcctgcacatatgtcaatagatttatacctaagtatttcttgactttttttttttttggtgctagtgtaaatggtagttttgggttttttaatctttcccccaaattcccattgttcattgctggtatataatacaattggtccttacatattgaccttttatctcgccatcttgctaaactcatttattatttacagaagattttttcacagattctgtgggagtttctacatagacaatcacttcatctgtgaatagagagaattgtatttcttcctctcgaatctgtattgccttgttgcactggttaggactgaatagactgtagtacaggggatgtgtcttagtccatttgtgttactgtaaaggaatacgtgaggctgggtgatttataaagaaaagaggtttatttggctcatggttctgtaggctgtgcaggaagcacggtgccagcctctgctcagcttttggagaagacctcaggctgcttccattcattgtggaaagtaaaggagagcctgtgtgcagagatcccagggcaagagcagaagcaagtagcggggaggcgccagactccctttaacaatcagccctcccaggaactaagtatagtgaatgaccaaccctttcgtgagggatctgcccccatgaccccaacgccacccaccaggccccacctccaacactggggatcaaattacagcatgagatttggaggggacaaatgtccagattttatcagagtggttagaaaaaaccacctctccttattcctgatcttaagggaaaaagccattatcttttaccattaaatctgatgttagctatatgtattttgtggatgtcccatatttggttaaggaagttcccttcaatttctcattttctgggagtttttgttatgaactttctcaaatcttttcttgcatctattgagatgatcatttgttttgttttttcttatttagtctgttaatttggtgaattgcatagattggtgaacttaccttacaatccttggatgaatcccaattggtaataatatgttattctttcgtgtacttttatatatttctggattcattttactaacatttcggtgagaatgtttatattctctattcatgagagttattcatccatagttacgtttgcttgtgatgtgtttatctagctttggtattagggtaaatgctagtctcataaaatgagaagtattcccttctcttttattttctgtaagatatcgtatagagttgttatgttcggaagatttaactagtgacactgagtctggagttttattttattttgtttttaaaggtttcactataaatacaattttgttaatacatataagactattcaggttgtttttcttcttaagtgagtttttgtagccttttttcccaaggaattagttcatgtcatctaagttgttgaatttatggtcataggattgtttttggtatctttttttttttttttacatatgtgatatcagcagtgataccatattccactcgaatattgtagttgtgccttctcttttttcttaattagcctgcctagaaatttactgcttttattgaaattttcaaagagtagcttttggtttcactgatttaatgccttttttctgaaaactttcatcatggatgctatagagttcacaatatacatttaaaaatctgaatctacctccacataatgctatgctgcttcacacggagtataaggaccttataacagtgtatttctaattcccctctcccattccttctactattattgtcatacattttacttttacatacagtatcaacacaccagatatttttactattacagctttaaccagtcagtaatcttttagagaacttaaaaataaataattttaatttaccttcctttattccatttatgatgcttttcatgtcttcgtatttatcccagtctctgacctatatcatactccttttgcctgaagaattttctttaatgtttcatgaagagtatgtctactggcagtaaattccatgagatttgtttttgtctgaaaagtctttctttctccttcacttttagaggatatttttactgggtgtagaatcctgtattgagatgtttttctttaaacatttgatgtaattccactgttttcttgtttgcatgagttctgccaagaagtctgctatatttcttatcttgctcctctgtaggcaatatgtctttttttcctctggcttccttaaatattttttatttgtcccttctttttcagtagtttgaatatcataactagatgtagagtttgtgttttgttttgttttgttttgctgcttgatgtcctctaagctttgatgatttggtgtctgtcactaattttggaaaatcctagcccattattttttcagccatttcttctgtcccttctgtttttctttctgattttataattccaattatgtatatgttaggctgtttgatattcttccacagtgcttgcatgctccatttagttttgtttgccttgttttttctctttgcatttcagattgattaattcctattgacccatcttcaagttcagtagtcttttcaagtctgctcatgagcccatcaaaagcatttttaatctaaatactgtttttctgatttctatcatttccatttaattctttttcacttaattatttttatagtttccatttttgtgtgaaattacccgtctgatcctatatgttatttactattagagcctttaacatattagctatagttgttttaaattctttgtctgataggtccaagatacatgtcatgtctgagtcttcttctgatcattgttttgtctctttgtggagtatttttccttgctttttttcatatgcctcataatagttttgttgttgttgaaagcctgttatgtcatataataggacagtagacactgaggtcaatattttgtgtggttggagatgagcatgcttttctttccactgggccattaatatgaaggtttttgttcgtttggtcagagatttggctaggtttaaagtttatcattgccatggttaccctcattctactcgaggcctaagtttctctagtggaatcatgtgttcatagcatgggataatttttcagacttgtctccgtatctgctccccatttgtcttttgagtttccctgacttgactttgagtcttctctttgcactggtcccctcagggaatctgcttcttgcagctcccctgctgtatccttcaattatgtttgcttagtgcttttgagtgtgtgcaggtcatgtgtgtgcagggattgagggcattcttttctgttctgattaagcctcaggcttaggcaggtgcctgtgaatctggggcctgaggctgtagtcctgacaagtgttcctgctccttccctacctgtcatgctgggcctagcatatattcccgcctcccttccaggggtagaactccttctccacccccgttcccctgccctatctgcagtgcgatcccacccctgccctcatgctacagtttttgttttgttttttgctctttctcctgcatagtaaggctttcattccttagggaagatgggggtgatgagtgtgtgcagagtttggtggtagctaccatttctttctgaccacagtaagattctagcagtgccttaaagctttagttttttgtccttcaccctatagattaaagcttttgttcttccaggaacataggggagatacgtctcaggagagttttggcagaggtgcctgttcttcccccacatccagcaccaagtgggggaagctgtcttaggtttctcattgagctgccctgagagcaccctttagggttcctggaggaaaatcctactctaggctcttaacccctttatgtcctggtctgtggggctttatacacgctcactagcccatacttggccttaggcagtttattcagacttctagttgaatcttcctatgggcttatagtgagttcaaggtgtctgtcccagataagcaaatggttgggtctgtttctccctggaaatgtctatctctttctggattttctaggttttgagttagttttttccctgtacccttggttctctgacagagtcaagaaaagtcattagtctgcacttcgtccagcatttttcctgtggtaagagtgagagcaatgttctttccagctctctacctctaggagctgaaagcacaagtttgctgtagccagtttctgccacttaccttttaagtcactctcagaaaaccaaatcgttctttagttcctttaatacccaagataatccccagatcacaaattaaactgtttagtcccacatagaggaaaggctctcggagcgagtttttgcctctcctatgcaatcgtgtgtcaagctggctctctgcagtgggaaaggggctgtggtaggcgtcccctctttatccccacttcagcttcttctccatctctctcagctctatgggttccacggaaccctcccagtttgtagatgtagagactcgggtaggaaagattggcaaaaactggggtgtgggcagggatctaaaggaaggagacagaaagttcagacttgaccagtactttctggaactagcagaggtggttggttataggtggtgttctcttgttagactctttgtggatacccctgaaacccctatatccttgggaatctccaccttcaggccccttaatatgtaagagtgtaccacctgcagctggtaggtcctggtgtcccctccttaactcctaccatcaggggctacacttccagcttctttgttctctcacttgcctggcagttctcttgagcaaagtctaagacactgtttctcacacaatgtgggggaaagttttgcttggtagcctcttgccataggtggtggaagtatgtcattccaatccaccgctcttccactgcaggtgctctggccagaactgctgtggtgtgagtcaggcactagtctgctgtttccctccaaattgccggggacacatccagactctcccagtgtcctcctgaagtcctcacgcttgacttgaagtgaagtagggtaggggctgaactcccagcatcctggcaactttgttcaaagtatttctcctaatttccagctttttgggcagcattttccccagtcttctttggggtagaaatgtgtgaccagctaaagtttgcaaaacaagtttttgacatccaatgctgcaggtcctgttttgaggaccttctaccatgggatgtggaaagaatcatcacatcaacttcttgggacctcaatataaactaagccaggaagaattcaatatttaaatctttttgtcctcattctcctaaaatgaacagatgcttttagaaactggttctaggaagtactttttctctgggtattatttttataattttaaaatgtaaaaacaggcattgagaactcataacatcttaagatatttagagtttaagatattgaaaattacatttcatatttcaaaacctaaaatacaatactatagtagaccttaagtggccaaatgaaagatgtttttggagaggaatggatacttactgtcttttcttttgacacagtggcacttttaatcaagataagtgaccaggcttccatgtgaagtctctagagctaaggtaggagatactagttgggctggattcaccaaatgttagcattttaacacagctctatcagacttcacacaggggccccaaaataatttttgtgtaattgaattatgtccattttaatagggattttctttttaaacgaattctactttgttcttttcttaaagcaaagacttttatgctaagataaataccttctgtccctctgcccctctcccatatttcctttgtataaatcttcattcttacattcagaggtgacgtgggcatagttgaaaggtcacagttaaaagctctagcttcagaaccagagaggcatggatacaaattctggctaggaacagaccccaatccattggaatgaataaacaactcatcagagtggccacttggtctttcagtccctaaaccctcctggcccatggcagctgagcgttgcccctgttttttccatgcattggagagtccgcctctctgagctatgtttcctccacacttgaggccaataatcatcttgcagagttgttaggaggatcaactgagggaccaactgaggttccttgcacatagtaggccctcagcagaaagtagctgctatgacattgttaaacgttcgacatctcaaagagagaacaaccgtgttccctctccaccccacagttcagtgtgcccagcttggaaactcacatctttttggggattagttaattgattggagatatgaactgtatctagtggaggcatgtctttatcttctagagaaaaatctttagatggtttatcccttttaactttggttataaaagtattaaaaaagaatacacaaaagatctgaaaaagaaacaaaatcatctgtaatcctatcacacagagttaaccactgttaacttttaaagcatatcttttcaaacttttttttctatgaaaatatggagattcgtataagacggggtatcatcctaaagtcaatgtggataacccctttcactcagtgctctatcacagacatgttttcatgtcagcaattaacaccttcatagaatgccatgatatggattttctaaatgtatttagccatcaatggaatttaggttacttgcagtgaactgcagtgaactgccttacacataagtcttttaatacatacacagctgtttccttagagtacattcgttgaagtaaatttgctggaacagagggaatgcctattttaaataatgagacatatcaccacattcactttggaaaggctgttctaagttgtacatactcccattaaagcatatgtaatgtccctgtctctgcatttaaaagctcttgaataaaacatttttatagtctttgataaatgagagaagtttctccccaaaatcaaacagtatcttttcaatttttttttcatattaaaagagaaaaactcagttgtttaaaaaataaataaaggcttttggccgggtgcggtggctcacgcctgtaatcccagccctttgggaggccgagacgggtggatcacgaggtcagcagatcaagaccatcctggctaacacggtgaaaccccatctctactaaaaatacaaaaaaattagctgggcatggtggcaggcgcctgtagtcccacttgggaggctgaggcaggagaatggcgtgaacccgggaggcggagcttgcagtgagccaagatggcaccactgcactccagcctgggtgacagagcaagactctgtctcaaaaaaataaaataaaatgaaataaataaataaataaaggctttttaaccacaaacgaagttctcttgtcatgacaactattaacactgtatttatcggaattggtgaaatcttaaatatcatctcatataatcctctctctttgtagatgagcaaagttagatcagcacttagagggttcgaagaggaagagtctcctctgtttctgttatctcttttcttctcacccaccttctcatattcaaataatcatcttttttttaattcctagaggaaatattatttttctcctaatatcagggcagccctgtgacatttaaaattcttttattggaagtctaacatgcatacacaaaagtatacaaatctcaactgaatgaactatcacaaagtaaaagcctgtgtaatcgccactcaggtcaagataaaaaaaaattttaattaacatttgctaatacagatgatcataatgaaaaatgtaaaattgctgtgacagtctcttggactacaacttctatatccgacagtcagtaatttcttgggagaaggtacccagttggtctccccacctttacgattatacttctctgggggacaatctgtaatattctgtgtgcggtaacttgcatagttttaaaacgatccacaccactgaatattcttactattcgtgaagccaaaccaagcagttgtaaggacaaaacatggcggctgcaagagtgtgtgattaggatgacaccactgtggcctaaaaccaaatgctttggtacaagtcaaaaataaatggtttggtttcaagtcacaatttggtattacccttgcagttactagatgaaggtggaggcaaacaactgggcgctttgcatctgagaagtctgcagagagtgagaagtatttgctgcagccgctgggctcagccacttgcccctgatgtcagaactccctggaggcagagaccgcagcaccctgactcctggaccccacgcccttttcaaggggccaggctgtgcttcagaaccttggcagagaaggttccaattctgtaccggctcctggcagccagccacgctcccggtactcagcctcactcagccattcgctgcgtgtccaggatggacacccagtttaatcttgttgttcagtcaatagcttttgcattatctttctttttgtggttaatgtaccatttttcttcttttcttcccctacacaaacactgccatgcctgaagtacttcccctgcttgtagagaagttatagcctgggctgtagtggaacagtgctctgattaaagtgattaaaactatatacagcatgcataattaacctttgcgcggctgtcacagcaagctgatgcatggagctgataccatatctgtctgtggcaggcggcgtatgctacatgaccattttttttttcctgcagaattttaatcacttgagataaagagccaggagagagagatcaaggctgtattaatcttctcaatggctttataatttcccttctattctgctgctggtaatcaagaaaaataatgccgccttaatcctggatgccaaggtcaatcatctctgtgccctttgatagtaaggatgtcattatgaaagggtttttaatgaacatgaacataatgctcgccgcactcctcagggagatggatgcgttctgcaacttcgggatggccaggtgggccttcattgctgacaaaaatgattttaaaacattagctctattagaaataaatcccgaacagctggttgaggttgcagaccagccgtacccagcagtgattgagaaattcaggaatgagctgcagcaggtcaacaggtgagaagggcccaagccctgattagcggttgggcaacacagcgagaaccagcacggggcgggggccttgggtagcctcagcagcaggagcccggcccgcggcgccaacaccagcgcctctctggagggctgccaagatcaaaaaagtgcagcgatgcgcagatgcgtggtgacattttaaaacaatgccctggtcttttttttttttttttttttttttttaagaacatgcagacaggtgaaaaacaaaatcctttcagctcaaacgcacctgaactaaatcccagagggctgagtgctgctgtaccactccctcccgctcttacttggttttcccaaaaacacattccccaggtcgaggtggtggagctgacccagccttcacttcactgaaagacaaaccagacgggctgagagcagttcccgggcctccagaggctgcggctcgcacagctttgccggctgtggttatgaactgtgatctgacagtggaaggcagcacttgttaggaaatctttatgtagcatgggtcacttaccctggtgaaggaaaggcgaggaaggcgtcgagttcagacttcaaatacacatgaggtacctgggattaggggaaagaaatgagtaacaagccgcccactcacccttgagaacaaaagaaaagagagaccttcatctctggtagacaggattttaataagatttgggaaaacacacaaacattcttttttttttaatctttatttttcatttattttcttcagcttttaagttccggagtgcttgtgcatgaggtgcaggtttgttacgcaggtaaacctgtgccatggtggtttgctacacgaatcaacccaccacctaggtattaagcccagcatgcattagttattcttcctgatgctctccctcccctacccatgcaacaggccccccagtgtgtgttgttcccccgccatgtgtccatgtattctcatcgttcagctcccacttagaagtgagaacatgaagtgtttggttttctgttcctgcgttggttttctgaatataacgtcttccagctccttctgcgtccctgcaaacgacaagatttcattcctttttgtggctgcatggtattccatggtgtatacgtaacacattttcttcatccattctatcattgatggacatttgggttgactccatgtctttgctattgtgactagtgctgcaatgaacatatgcatatgcgtgcatacatctttataacagcatgatttatattcatttggttatataaccagtaataggattgctgggtcaaatggtatttctgcttctagatctttcaggaattaccacactgtcttctacaatggttgaactaatttacattcccatcaacaggaaaacacacaaacattctaaagtgagccctcacaccagaatggttcctataaatggttcttctttgtatgtcttttaaaatgcattagatttactttctctcaagtggttcatggtacagcttcccttcacattgagggatgggctacggaagcttggagctctgttcccgggaggctcctgaattaccagctatattagtccattttcacgctgctgataaagacatacctgagactgggtaatttataaagaaaaagaggtttaatggactcacagttccacatagctggggaggcctcacaatcatggcggaaggcaaaaggcacgtcttacctggtggcagacaagagagaaacgagagccaagtgaaaggggaaactcctataaaatcatcagatcttgtgagacttattcacgaccacgagaacagtatgggggaaactgctccatgattcagttatctcccagccggtccctccaaaacacgtgggaattctgggagctacaattcaagatgagatttgggtggggacacagcccaaccatatcaccaggtggggggtggctgtagaggcccacttgaaatgcctttcactcctgagaatgctgcagggagggcgaccttggatgggcagagtcaaggtcaatgccgtatgagccaggagaccctgatgcgggaggcccctctttctcttcaagggctttgctcattcttctctcttttatcatctgaccccaaacactgattctttccttctagaatttgtgtttggactcagtaaatacctccatttggattctactcatttagaatgtatgatgatctgacctagtctgggatgaaatttactcttgtaccatctttgagagaagtgtacatggagccagtgtagaatgtaaatagcattgttggagcgtgtttcacctccttccatgaacaaactgtttttaaggacttagacaccgctgttgtcactatttacaaatgagccttctttttttttttaaaagccaacttggcagggtctctcctggaaaccactttgttagcaattctcttcaccagttaaaatgaaaactgaattataaaaaattctataatttagacattctctgcttcctctgagttactctattgacgcagaaaacaatttagtcatgcatacctaagagattgttctggcttttttccccttcaaatgtaatttaggtaatggaacatttgccccgtttccatagatcagttgaagtgctggctggaagggccgcccagatgtgatcctcataagaaattggaacataggaactgccacactgagttattggtgcagtttatggagctcagaggttttctactggtttctacagagcccacgggttccagggaggtgcctagaggtcttctgaggatgaagcaggagattcacggggtggccagtgggcaggaccccacacacacaggcttcgaccagagaagcctgctttcctctgttttctgcattggggttctcctaggatttgttagggggaaaagaggtttcttaaaagcttaaggccttgtatatagccctttgctctgtctcaatagaatttataaagacaagattgatctccttgataagtcttaagcgaggaacgtgcctgaacggctaagtgcttgttgcagacattatgagcctgtctgccgcacatgaatccagctgtgtgtgtgcacatgcaggtgtgtgtatgtgtgcggcccttcattatttgaggcccctaaaaaatcacgtcgttgccaaaatgagttccagaaattcatccagtaaccagggcacatggggaccaacagaagactttgagcttaaatagtcctggaccccagatcgtgcaggcctttgacctctgttcgaagaaatcaaaactgtgccatgaagacagaaccagaaacctagagtcgtcctctggacctcgctccctcgctccctccctccctccctccctcccattgtctagcagagggatcatcactcttcctccacggtggttcttgaatacagtccttcctccattcctcttgccctagttctagtctcatcattttggcctaaatgacttggtatcttaatttttctgtctccagcgttttctccttcactcaaacgtccacatggcctcaatattcctacttttaaaacatcaatacgatgaagtcaccaaacttaaaaataatctttagttgtttctcattgccagaggatgaaagtccaaagtccaacccccttaggaagatatttaaaactttacacaatgtcattctaagtgattggttttttgtttgtttgtttgttttttgtttgtttgtttttttgtttttttttttttttgagacagggtctcgctgtgtcacgcaggctggagggcagttgcagaatcatagctcgctgcagcctcgacctcctgggctcaagcgatcctcccacctcagcctccgaaagcatggggattacaggcgtgagccactgcacccggccgcctttctttccttgtagctttttgatggctgtgcattatttcatgtcccactagactgaggctcagtgagggcctcttgcgtttgaaagccttgtgtctggcgcataaaaggagttccatgggtttgaactcagtgcgcgggaagttgtgctttgttgtttgatactgttggtttgtgagtatcactgcacgccaggcctctaacgtttgcctctttctacctcctcacaactactttactcagtgagagcagttagcgccgtttctcagatgaggacactgagtctcagggagattaggcacctgggttaactttattattatttaccatcctttgcatcccccatctttgagcacatattgtgtgccaggcttgttctaggtgctgggaacacactcactggaggctgagggcaagtgcacgggccagtgtggggaccggcccctccagctccagctcccaggaactacagctatgggcagagcccatgaagcaagcgtggttagatctctataaatagttacatctctggtgtggctccttccaacttgtgaaggacaaggtaactcctcagcgtgagtcattactgaattacagattagctgatggggccttctctgctacagagtgggcctgggctttaaggcctgggactaggggaggtggaagcttatccctttctcgccataagcgctgtcactccagagcggtgctgcgcaaattggaaaggagataggaaggtgatgtcctttcacccttgacctcctagtgtgtctcccccgacccccaccccgccccatctctgccaatagcccctggggactatggctaaggggtcaggtgcacctgagcctaaacctgcccatccctaaggctgttctggtaattcgggaatgagggatgtccacaacgcgagggctgtgggtccgagaggccttccctgctggccatggcagtccctagtggctggttttgagcgagtgctataagtgcactggcagtgactctaggccggctgctttgggaataacgtctgtaaactgactgacgcccggtggcaacagagttccttgaatttggtaacttgggggtgggctgcgtgggctgtgggggctgaagccacctatgacacacactcatcacattccacagagaatgcagtgcagccctctctgatgatttatttgctctgttttctgtttattgtacgttattatccctgtgctttcggtacacgtgtcacttactaagaacccaccatggctttgtcctatcaagtcggccccgtctagcacctcaggcctgtaccacctggctgcggctcccagccctgccttcctccctcttgatggtgtgggagaatttcgtgtgtctctgttttctttcctaagttgataaacgctgtggtatcaattatcatatctttcaataaataggttagatgttgcttaattgtttagttaattcctggcctactttatttcctgtgatgccgccatgccaagctgcattagttgtacagttccattgaagcctttcccttctcttgtttcctcccaaagttcaaaataagtaacaatggtgatgacaaatgctaacactcatttagcactttctggagatgccggagaaaagtatgcattctgctgttgttttgttgcgaattctcccacttactcctaagttgagttctgagtttggatggtctcagaggcatcccgtgaaaaaaggatttcagtgcaaggggtttatcgaggaggtgatcctaggaggcggtgccgtgccacagggaagggaaggcagcagatcggaggttatcaggcatggtggccccgcagagacctgcagctcagcccctcaggaacaaagggaggtggtgcaaaacacggactgtacagttatcctacgtcagggatgaaggatggatctgggccttctacagcaactcccagcagtcacctttgttcagtgctgcacatcggggattctaattctctggaacatctggtcattgtggaagaaagcagagtggactccagccaccagagagagaaagctgttaggcaaagagatagagatgccggacataggaagtcggccagcatgcgctgtacggctgtagaggacacaggcagcagcagcacggctgcaccagaccatcggggtatttttactttacagataatgaagctgagtcttagaggactaagtagcttgcctccagtaacacttggaagtcttttgtgttctttactctctgaaaaattctgacaatacaaatatttaactttcagttgagttcaccagttgttcagtgagcttggtttctgcctatatttgggttgggtatattttccacttgaccctgcctcaaaagttggcttttggccagacatggtggtaacacctgtagtcccagcattttgggaggctggggcaagaggattacttaaagctacaaattcgacaccagcctgagaaacaaagcaaggacctgtctctacaaaaaatattaaaaattagctaagcatggtggtatgatcctgtagtctcaactacttgggaggctaaggcaagaggatcacttgagcccaggagtttgaggttgcagtgagctgtaatcacactactgcacaccaacctgggcaagagaatgagatctcaatttaaaaaacttggctcttgaagtgccaagcctccttgcatccatgaaacattatgttgcagcctactctgaagagaaaccaatgaggctacgttaatattttttttgaatgatatatttttaattcagacttggagtaattgatgggctaggttatgccgctgttgcaaacaactcggtaatctcagtggtttgacacagcctgggttcatttctcacctatacagcgtccacagcaggtccatgtgggtactcaggggtccaggctgctttgatcttgtggctcccctatctgaagctcagcagtagccctggcaaatcacaaggatgactggagacttgtgcttggacctttcactaattcactccagaaatgataatgacatttctatttccatgtcattagccaaaaaaaatggccccaactaattacatgaaagctgacaagtacaatcttccttgtgcctcgaacaggcaggggaggaaccgtggagtattagtgaacatggaaagcatgtttcccagtagagaagtaataataattgagcaatcatgatcaaggcccgcctagggcatttcctggggatttctgaaaggctggaagaattttgccttgggctgtaaatgtcaattgctcattaattcctcagaaatgcccacagccaaggttgctattgctaataaaattcatttgtttggttatttaacaaaacaaaaaaagcatgttgtcattttcccctggcctgatgattcctgaagcagatgattattctctatgttctacatcatatgagtttgtatcatctttttcttttctacctctccaagtgggtggggagtaaatctcattggcctgaaatatcatcacgggcagtactcagccattgttctcacagctgttttgaaatataaataacaaaaaaatgcattttaacgttaatttcaatatttctttccgccttagcaactgacgtaagatttgctggtattgggttttctgcaaatttttattcaaatgtgttgtcttgtatttcttttgtctgtctgactgttttacagaaaaagtgaccactatgtagttcttgtcaccttaacaataaaggtgcttttcaagtggtctatatttcttttaaatatgtttcagtcaaaaggagaccaaaagagttagtaaagaattgggtcagccttactgaaacaaatggttgaagtttgacttctctcatcagtgaatgatagatgccgcaccttctgcctggctggcacagactccatttgatgtaggaggaactcatacccttgtagcttttcccacgttgttgtgaaaactgcggaaataattccttgttccatgtgagaacgagtcatcacttaacttgatgctgttttcatcatattgtcccatcccacagtctggcccacagcctggcccacagcatcggggtggaaccagaaatggctcctgcggagagcaaagcaggacatgaaccgtaccccgcctctgcaaggcttatgctgttattagtcctgatgtacagagtggattcacagaggcccttgaggaccaaaagagaaaatatattcagtaaatcaatggtgatgcgttaatagactgctgctgtatttgttgttcacagaatgtaattccttgataatggcattttctacagtatatcatcacagaacaatagcaatatcaccacaacaggagtgactttgataaattatacaagaataggatcttataatttagtacagatctaatttaggttaaaagtattggtggagaaggagatttcatttttaacattgttcagaggtacaaaaaatcctgggagaaaaaattcagacatattgtgagaagccaatgcacatattaagttattggtgcagatttcgcaaggttttcacatcttttgactcattctcgtattctatatgttatgctatatgttattttaatgtttcattttactagaagttaatctatgtgtctaaaaattgcaagagtgttaaaaaggaactatggctctttattattttaaaagtggagatctaggaatagcataattttgttgctattgagtttttaactagatgtgttgatattccttgataatgtttcaaggatcctgacataatcaaccgtggctcttgcttcctctgggaccttgaagctcaaaaacccagtagcagctcttagcactcttaaggctgataaaaattgagactgaaagtgatatctaatcaatgcctctgagattcaatcaaatattaagatccttgaggccatcacactatttaattggattcctaatacttctttatactcagatagactcctgtgtccaaaggcactcacattggtgaagctggcagcacatcgtgagaggaggccattctccctgtcctggcccctggcatcccagagtcaggcctacagttgggctctcccaggacagtgaatgaagtgcaggtggcagaaagacaaaaagagggtcgagttccttcatggcagctgtagctgcattggaatctaccgtggtggtgtccagaggtggcatgccctacagtggtaccagtggcattctggctagatgattctttttttttttagggatggtgtcttgctctgccacccaggctggagtgcagaggagcgatctcagctcactgcaagctctgcctcccggcttcatgccattctcctgcctcagcctcccaagtagctgggactacaggtgcccgccacctcgcctggctaatttttttgtatttttagtagagacagggtttcatcgtgttagccaggatggtctcaatctcctgacctcgtgatccaccctcctcgacctcccaaagtgctgggattacaggcatgagccatcgtgcctggcctatatgattcttactagaaggcggaggttgtgtttcagaggtaactagtctcctgctggtctgtcttccaaggccagtcaacctcttccagcttttgtgaactcttgagaaccttccaggaaactccccgctcctcctcctcacttttgtgtaagttaacctgattggtttctatcatttgcaaccaagaacctctgactggttcagtggtcagtattggctcaacatttcctaaatgctcaaatcagacagagccttgggagaccgtctgtccctcattttacagatggatttcagacatggccctagctcagagtcctgcagacagttggtagctgagcagggactagaactctgtcctcttgattccagatacagtgctcttttcacctgtggcctttctagtctagagaattactctgcagacctgcactgcatggtaggcgctagccacatggagttgttgagcacttacaatgtggtacaatccaaattgatacgtgctatgtgtgaaatacacagcagattgcgaagactttgtgccgggaaaaatgtcaatgatctcacatttatgtttttatgttgattgcatgttgaaattgtagatgtgttgggtgagataaacaacatcattaagcttgttttttacctttttctttgtactttattcaacatggctgtcagaaaaattaaagttgcatgtgtaacatggactatgcacacgttgaaccaagctgctgtatgcaattataagaaaagataacacttgagtctctatgggtaacattgggcctgtggttattgtgctgggatattgtatttgtttttgctgtggttaaaaaaaaaaaaaagtagcgggtgtggtagctcgtgcctgtaatcccagcactttgggaggctgaggcagtcggatcacctgaggtcaggagttcgagacgagcctgggcaacatggtgaaaccctgtctctactaaaaatacaaaaattagccaggtgttgtggtgggtgcctgtagtcccacttacttgggaggttgaggcaggagaatcgcttgaacccaggagggggaggttgcagtgagccgaaagcactccagcctgggtgatatagctagaatccatctcaaaacaccatttatttttcactatgggtctaccagttggctgtggcttcactgggcccaaccaggccagcctaaccttagctgggctctatgtgttttacattttgggacccaggctctggtggagccatcactgtctagagcacatccttcaagcaccggaatagaactggaaacacagtagagactcaaagacaggataagcccagtggtacttccactgggaaagaggatgggggaggccccacagtccacagcagtcctagtgtcctgctgggcaaatatttcaaggacccgtaggctgggagtagggggtgtcgattgggcctcagtcgtgctcccggggaggactttccaggccgtggttttcgtggctctgaatctgccctctgccaggtgcactcttctgtcatcctccatggctacctctgaggaaggtgctggaagacatgctctccttcatggctgagcagatttcttaacctgcttcctgcccataggaaggatgaatgccgaggatcgttttagatctcaaatgccacggtctatgttaatccagccgaaagtgtagttatcgatttgtcccttttgaagctgtcctgtttgtttttaatctctttgattccggtcaaccccgtgtgcctacagtcatttttcgtgcatgtcctcctttctctaaactcaattccaagtacactgagcacatcatgcttccaacaggccaaattctgggtctctttctctaggccattttgtgcagttgaaagatttcattggggaccttgataatccaactaaaggtttcggcgcaagagccaatgattgcatctttgatttggtctttacccgtaggctgtgctttcacggccaaccttaatttggtgagaaattgcttcactttaaaatcctgaaaatgttgtattttctctcttccctttcaattgtatttgcaaagcagtgagttttttgggaggaggcaaggtgcatttttttttccttatagcacggtgtcaaaggcattctataacaccagttcacacaggcaagattctgttttgaaaacaagtttagttaggccaattttctaagttatcataggttatttcttttttctttttctttttttgccgggtgttttaacactgcatatcttgggttgccatttttccaacttcctttaacaactttccagcttgccatcacctaaacccaaaaccaatgacccatatttcaggtttttgtaatggcagccctacttctgtgtaccaatttctgtattagcttttgctgcagtaactagcaattctcaaatctccatggcttccaacaacaaacacttatttttcacttaagaatcctgcgagtcagctgcagctctgccgagcttggctgtgttctccacgtctcctcatgccaggctgaggctgaatgagcagctgccatctgggccctgctcttctcatgctggagggcaggagctccggaggggaagcgggaacccccaggatctcataaagcctctgctgggacctggcagccgtcccctcctcccacaagtcatatggcaagcccaaggttaatggggtgagcctgtacccttcacctcctggcaagtcacgatgaggagagggcagagacaaatcattttgaacaagtgatacagtctctcacaggcatagattccaaaaagaaacccaggagagagtcaccatgcctcaaatcaagaacagccatattgcatttctatcaaggcagaagcacaggtgtgacagtgtgacaatgaaccctgagaccggaggccctccagtccaggtggacatccagctatgcagccagctcagtgcagccgaaagaacctgggaggcagtccggaaagctgagttcctcttacccgtatccctgcagcaagccactttccctctgtggatctcaagttcctcttcaatattaaccaagagttaagcagaatcgtgggttgctttcgaggatgccgttctgatctctgccagcgcacttcacatggcagggaacaggctgccttcccaggaggccgagctgcagtagaaggagcatgagtttaggaatcaggccaatttgagcgggaagcccaggcagccgtttaccaggtgtgggtccatcatataccctctgactctgtttcctcatctgtgaagtgaacatcacagcatctaactctcagggctgtgggtaggataattattttatacagtgccttttgctaggaaattttttgttgtgttgagtcaaaatctgatcccttaaccagtgaactccggccccggttctgcctctgcctggggcagcaaaacagtgattaggaatatgggcacgggggtcatcccacctgggtctgaatcgcactgtctgctcctggtcaggatggccggggggaggatccttaatgcccccgcggttggcttgctatgcttatctgtaaatgagctactgataatatcaacttcatagttttgttgtggggataaatgagccggtgcatgcaaactcaagtagctgttattatttcagttggcagctcctcaggtacctgagcctgctttccataccttctgggtcatcccgtatttcttcagggtaagcaacctcacatttctccagcattctgtagatgtcaagctttctgcaatcctcccccgtctagctgtcctcttgagaatctccttcaggagctctggttaagagataaagaaacagtgagggcattcgagttcattatcccagccacgatggcattctagatgtctccacagacattcaggatctgcccagggtcccacatctgtctcttctccacatcttaccctgccttctccaggtgatggtgatttcgtgatcccagtcacctgcccccaccctcaccttatctgaccctggctcctgggccacccacttgccacttggaatatttattgtctaactgattttccagtattaaggattttacaggtttacactggaattagaagttcatctgaactgcctgtgatgtccctgctggtttcccaatggccaggcactgcagagatgtataagatacgagaatacagtcacctaaagacatgggaagttttgtaagcaatgtctcccgagattccccattctaaatatggcaaggagtgttttaagtacttcatgcttgaagcttttcatgcatttccatcgttgcagttggaccagttttaaaatatatatatcataaataatcttcagaacattttaatgtactaccgatggtattaaaagtcaaagctttcacaaaatttaatttacttctccctgtaacttaagaacagttttaaaatgtgcatggctcctgctaaatttaacagcttccccttttgccttctcgactggaggctgcaacaacctgagccaggaggtctggcgactacaatgtttgagtgaagctgtgagatccatgcctgtactggaagctcctgacagcctctgcagggccttggtgccaggctccgggggtggtgggggagtgggctttccttcttagaaagcctctaggctttgcaggttcaggaagaagctcaccagctgggtccagccactgaaaggaaccctgagcctcagtttgcagcccagagatgctccggggtctcgcccagtgcatattcctggagagctacaacatcagggcatcagatccacagaagatacatgtgcttcactatacaccaggtgtgtattgaaactaaagcagagtaatactattttttcttttttttttttttttttgagacggagtctcactctgtccccccggttggagtgcagtgatgcaatctcggttcactgcaacctctgcctcccaagtttaagcgatttgtacttcagcctcccgagtagctggtggcacgtgccaccatgcctggctaattttttgtgtcttttagtagagaaggggtttcaccatgtcggccaactcctgacctcaggtgatctgcctgctttggcctcctgaagtgctgggattacaggtgtgagccactgagccctgccaagactctcatttcctaactcttgattaccagcgtgtctctaatgtacattttactgattcattcctctaaaaatattgttgcttttactcaatatggtaaaagtttctattatagggtaagaagaatagcacaaaatattcaccaggcatggaggatatcattgcagttcaagaaagaaatcataagtagtaattaaggggcttggtacccatagagtcatctcatcatcactgtaataaatcattcttatatttatttattggagcctgaggatgttaaacccttacttttgtatgaccattcatagcttattggtgctttcatctttatagaaacacattagagtctggctgcctcagggcccattccctagtcacttccagccagacatccatgtatcaaagctctagccaatcaacatgtagtggacgtctgctaagtagggcttccaaggatgttttctgtttagaataaaaagggggaaatgtggctagccacatttgaccactatcccttcttctggaacatggatgtaaagctggagacagtgtagccatctcgtgaccacgaagcagtgatgaggaagacaagaagcaactcacggaaggacccatgccccctttctctttccactccgctgtcctgaggcttcttcttcttcctcttcttttcaagttgcgtaaagtggatacttagatccctgaagtcagacctttcttcttttctagtgtaagtgcttgatgccatcagtatccccaggcactgctttaggctcatctccccatttttatgttgggtcttcattttctttcatgacaaaatatcttctaattccctttgcattttctcctttcacccatggattatttataagtgtgttgttaagttctaactctttggcgattttccagataactttctgttactgatttctgatttaattctgcggtggccagaaaacatactctgcatgatttcaatccttttaaatttattgagatttgttttatggcccagaatatcttggcatatgttctgtgtgcacttaaaaagaatttgtattttgctgttgttgggtggagtgttctgtaaatatcaattaggtcaagctggttgatagtcccgttcaagtcttctgtttactgattttctaagttttaaagacattttaaaaaatgaaaaacgaaatgtttatatatttactcacatattgaccatttctgctgttctttatcccctgtgtacattcagcttttggtttggcatcttccttctccctgaaggcatgtccttaatacttcttgaagtgctggcctgatggtttaaattccacccagtgccctatgcatgagcgctggtaggagcacaccctcttcctggccttgtgtgggctgtcaggattatgttgcctcctcctgttatttcctggccttggtagtttccttacctgtatgcacagatcaacactcagcaaaagaccctgaagctctgtctgccacagctgcctcttctgtggcatttttctccactagctttagcctcctgggcctccgcagactctaaactctggcttgttaactcagcaagcccactgggatctgtctggcttccctcagcctggattgggaactctttcaaggcagcgagctggacactcttttgttttccttcacccaggaatcactgtcccgtgctgccggtggtccagtgtcagaaatcgctgcttcacatattttgtctggttttcaagctgtttaaggtgggggaataaatctgattcctgttactgtatcatggctgaaagcaaaagtcctcttcacctacttaaaaaaacttaattgtagcaaaatatacatgtattagtttgttttcacactgctataaataactacctgagactgggtaatttataaagagaagaggtagaattgactcacagtcctgcatggctggggaggcctcaggaaagttacaatcatggcagaagggtgaaggggaagaaggcatgtcttacatggcatcaggagagagagagcagaggggaagaactgcacacttaccaaacaaccagatttcgtgagaattctatcatgaaagcagcaagagggaaattcaccccttaattcaatcacctcccactaggccactgccacaacacatggggattacaacttgagatgacatttgggaggggaccagagccaaaccatatcaatacataacataaaatttagcatcttctccattttaagtctcccgttcagtaagaagtattatgcacattaacatttctgcacactcatcaccatcatgcatttccagaacatttccagcttgctcaactggaagctctttccccatcaaacaatgattctcattctccccttccccagcccctggcacccaccattgtacttcctgtctccttgaattctactactctagaggcctcatataagtggagacacacagtgtctgcccttttgtgtgtgacttatctcagcataatgtctttgaggctatccatattgtagtatgtgttggaatttccttcttttttaaggtaaaataatatgaccttatatgtatagaccatattatgtctttcctttcatgtgacggacacttgggctgctcccccttgtggctgttatgaacagtgctcccatttgccacgttcttcttaatgttcaacaactttgttaaaattatttaaatgcaatgatagtcatctcaccatgtagttcaacttgtttttacagctgtgtgtgtgtgtgtgtgtgttataatgggaagaagatgaaataaatggttatagttaatttgggaactttgatcaaatcccctttctttccatattcctttccttttttcttttcttaaatttcccttttcttatcttttctctcatcttttactcttctctttgctctttcttttctctcactcttttcttctcctttccttttctgctcttattccatttcttgccctcctttccttccatgtgtgcacagtacactgacccaggaagccgccgtgtgcacacacaccccaatcaacatgactgaggtgctacggtattagcatgaagcaactcatattccaggggcagagagaagatgtgaacatccatgaatgtaacctgagttgaagtggcctgaatagaagaacagaagtgcagatacggtgctttaattactcagtgacagaggttatttttggttagggagaatctggaaagtcttcattgtagggccgacagttgacctgaaacctgagagtcgggcacagttggggtttccaacaggtgcaaagattttctaggttacagaaccactagagcaaaaagcgcagacatgggacaagcctgctgtccggtacaatgtcacatcatgatgccattcagacctcttttcccaaagattctaactagcttttttaaactttacagtgatatacagaaaatgataaatacaagtcatcattaaaatggaacaatgaaaattactcacttttcatgcactttgcccttttctgattggttttagactcggtacattgcaaatatttttccaattttatcatttgtcttttgtgttttacatcctgttgtccttaaggaaataactgcaacaaaagagcagcatctcaggaattctcactgatgaaaatgagtcatccgaattaacaaaaagtttgaattactaacttattaatagaattttggttttattatgtcacgccccttgtgtcatccttgattgccaaactaagtcttagtaattagagctcgttgggaacgtgttttaataaatagatggtgattgtttcatttttaagtgccaagaagttcattctttactaggctaaattcatctgtaacatcttatgttgttaatcagtttaaggaaatattttacctttaaataaatgtatttttagcctaatttgtaaacaaattatcataaattctaagttaatggtttcccaattctatagtaaggtgaaacagtccatatctacctcattttattatcgtatcagctcaattttaggcctccttttggtttccatttaagtcatgagaaatttactaaaatatcatatttcctgtgatcctgtcagtcttactggtgactttaagtgaaacaatgtgtgagaattgtctttggaaagcaaagttgttcaccctccctgatctgctgttgaggaacctccatgctcttcttaatatatgagtatgtatcaccctcagtctccctacagaaatattgcgctttaacacttccactttttccatgacacatctgtccttgcccctccttggcttggagttctttcatatctccccatcatctacaggctaaagtctgtttgagagcagaactttgtagccaaaaggcccatttaaatcctatgtctaccacgtgagatgcaacttacaggataatcactcattttctctcggcatcagcttccttgtctaggaagggggagcagtgtggctgccctacagcattggtgggaagactaatgagaaaaggctcagaaagtcctcagctgtccccgggtgcagagtgggccctcccgaggtggcacactgccttgacctcctgagcagtggacaggttcctcctccctcccaggcctgctcagccaggtccaagctgcaccagctccacaggcacgcctgccacgcagccccgtggaagcacctcctctgtcggccatcagcatgtgggccatgctgcatctctctccccagatgtccttgcccaccctcagatatctccacgcatccctgaaggctgacactcctctatagggggcgttaccaggcccctgccaccccaggcacactgagaagtgctttgtccctgcttcccggacctggcacacagctctgctgcaggcattgtgtggaaatcacagttcttacctcacacattcccttgaccgcatgcattttaaagcatttgaatgaatttttaaaaattctaactgtgaaatatttcagccatgtggaaagctgtaatcggataccagtgtatgacactaacatttaacaaatacgaacattttaaagagaaagcagttttacaaaaaaacctaaccctcctcccagtttcctctttgctgaagaaaccatgaacctgaagttggtgctactccttctaatctgtgtctttatattttattacatattttcatccccataattctctggaatagcatttgtatatttttaaaatttacataaatattttcacctttaaagtggttcccctcaaatatttaacacgcgtaattgaacagagtctaaaatttaccaacatgttctgcctgaacaggcttcaatttctcttgcatcgttcatgttttgtggtccgctgtttaggttttatctggtttttcatccccaggttggttataataacaacacaacgtcattttttcctgtttggtgctgatttagcctttccagtgtgtttaactcatcattgcttctctcgtcctgcccatccttcttggcttcatatccttatagaatttctccttcagaaatcatttcccactggaaggctggaaatagctttatttaccctccctctctttttctcccacctttattttggaagatttcaacctgcagaaatgtaaggtgaattaactgaatacctgacacccttcacctagattcacccaccatgagcatttggccgcttcgagtcccctctctccccctctccatttccctcccctctttccctctttgcatgctctgtcacacactcgttttagactgacacatttgcagatttgttgcagacattcctccctaatactccagcgatcttcaacataaccaccataaaatcattgctcttgaaaatttcgcattgatttatgtgtagttctgttatctaatatatcattcaaattcaaatgtgcctaattgtagcaaaaaaaaagacctttatggcttttctttttcaattctagcgtccaattaaggattatttactgtctttagtaaaaacatctccttacccataatctaatcgttccctggcctttcattttttctcaacattgacatctttgaaaactccagaccagttgtttggcagaatgtccttcagtcttgaatttggctgactgtgtattctttgtcagattcaagttaactgtctttttttttcttttttctttttttttcccgacagagtcttgctctgtcaccaagctggagtgtggtggcacgatctcagctcactgcaacctccgcctcccgggttcaagcgattctcctgcctcagcctcccgagtagctgggactacaggcatgtgccaccacgcccggttaattttttgtttttttaatagagacggggtttcaccgtgctagccaggatggtctcgatctcttgaccttgtaatctgcctgccttggcctcccaaagtgctgggattacaggtatgagccaagttaactatcgtaatgaccccatgtccttgtcagtgcaccacatcagaggccacctgatgtcaacttgtcccattattgattattttgagtgtgattattaagctaaatggggaccaacaggtttgtccaaagggaaaggtgcatttttcctttgtgagttatcaataatctgtgtggtaataccttgaaactatgggactattctgtttcttaacactctttactcactcacgggtgactcttgcctcagtcaactattaccacgatgtttgtgtcctaacttctaccatcctttgtgtgtttattaggttagtcttcttctgtaaggaactccttttccttcttcacatttccattcctttttttaggaagggactcttgttctttgtgttaattgaatatgttataatatcccgttactcatttaggtgttaacattgtttcagatttggctgctgggcatggtttcagagtatctcctctatcttttccggatgttctcctctgtctttgagtgtgtctcactttctagcacaacaagctgctccaggctcacctgtatttttcctgccccagccctggaatcagccattgctccaagaagctttggtgcctttgagtgcaatatgatatttacgaaccaagatctggctgctaagtgtgcttattacttccttggtgttcttactcccagactcttcagtggctagaaatgtgcgcgtgtgcatgtgtgtgtgtgtattttaaatcatgagtttacgctgacatctctaattccagttcatcatcacagggttcttcctctcctcccattccatgtttgtgtctcccttctcccacaataagaaccctgattccccatcacattaatgtatttacccacttattcaatcctacaattcacacaaaattgtttttggaattgctataccgatactactgctcactacaaattcagtaagagagatttaatatttccttctggttcttcttgtgcctggaagatgtctcattaagggttacagtcagatattgagttctaaactttcttgccttaatttttttttcctcttccatttgttatattacctatttgatgtatagctaggtttactggtttctttgtaggaaaactttcctgtgtcttaattgaataatatatttgtggatatataaactgttagtatagttcaaaagtctaaattacatgaaaagatgtggtcagagaagcctcatcgccttccctgtccatgccttgtactccattctcaacaatgcttcataaagagctgttttcaaagttcctggtatatcctttctatgttttattgtttgctagtttttgtttgttttgctgaaataagaatatagcacagaatgacagaaaaaattgcaaaccatatatctggtaaaggtcattgtccataacacataaagaatttttaccactcaacaataaaaagacaaatggcctaattttaaaatggacaaaggattttaataggcatttttccaaagaagataaaaaaaacgggcaataaacacctgagaaaatgcttaacataattagccatcagggaaatgcaaatcaataccacagtggggtacctctttactctcactaggatgacaggttttttagtttgtttgtttgtggttttgttttttgttttgtttttttttttttgagacagacgagactccgtcgctcaggctagagtgcagtggtgtaatctcggctcactgcaagctccacctcccgggttcactccattctcctgcctcagcctcccgagtagctgggactacaggtgcccgccaccatggccggctaattttttgtgtttttagtagagacgaggtttcaccgtgttagccaggatggtctcgatcatctgctgaccttgtgatccgcccacctcggcctcccaaagtgcttggattacaggcacgagccaccgcgcccggccgacagtttttttcttaatggaaaattggaagtgttggcaagaagtagatacattttaacccttatacattgtttataggattgtaaaagggtacagctgctgtggaaaagagtttggcatttcctcaaaaagttaaatacagagttactatatgacctagcaataccactcctaggtatgtatgcaagagaactgaaagcatatgttcactcaaaaaatggtacacacatgttttttagcactcatgaaatactgctatgtggtatgtgatggtttggatgtttgtcccttccaagcctcaagttgaaatttgatctcccgtgttggaggtggggcctcatgggaggtgtttgggtcacggaagtgggtccctcatgaacagattagtactctcccttgggagtgagttcttgccctattggttcctgagagagctggttgttaaaaaagagccttgcacctcctagactctgtcttgctttctctctggccatgtaatcttcgcacacgagacaccccttccccttccaccatgagtggaagcagcctgaggccctcaccacatgcagacgtccaatcttgaacttcccagccatcagaattgtgagccaactacacctcttttctttataaaccacccagtctcaggtattctgttaaagtaacacaaaacagactgagatgtggtacaagatagatgaaccttgaaaacattatgctgagtgaaagaagctagacacaaagacccacatactgcatgaatcagtttatatgaaatgtgcaaaatacacaaatctatagagacagaaagtagagtagtagttcccaggggctgtggggagaggggcaatggaaagtgagtgctgaagagtataggatttccttttggagtggaaaaaatactctggaactaggaagtgctacacaacctggtgaatataatataatataaatattctgtaatgaaactagcctggtgcagtgactcacacctgtaatgcactttgggaggctgaggtgggaggatcgcttgagtccaggagttcaagagcagcctgagcagcagggcaagaccctgtctctacaagaaatgtataaaaattagcagacatggtggtgcacacttgtagtcacagctactcagaaggctgatgtggaggatggcttcagcccggaagatcaaggctgcagtgggctacgataacaccacttcactccagcctgagagacagagtgaaaccatgtatctaaaaaaaattaataataggccgggcacggtggctcacgcctgtaatcccagcactttgggaggcctaggaggggggatcacaaggtcaggagatcgagaccatcctggagaacacaatagaatcccgtctctactgaaaatacaaaagattagccgggtgtggtggtgggcgcctgtagtcccagctactcgggagactgaggcaggagaatggcgtgaacccgggaggtggagctttcagtgagtggagatcgcgccactgcactccagcctgggtgacagagcgagactccgtctcaaaaaaaaaaaaaaaaataataataataaaacctacttatctgtgtattttacagtcgtaacttttatgatatatgaattatatctcaataaaaatacaatcatttttaaagtataatcagcaccttttttttttccaattcatatcctggaaatcagcccacatcagttcatagataacttcaccattttttttattttttaaatagctactacgtgtttgttataccacggtttattctgtcagtctcctatatggacatttaaacgactttcactatttttctattataagtaatgccgcaatgaatatttgtgcattatttttgtatcactggaggtaatgttactctcattcttgaatgatagtctggatgtatataaaactctaggttgatatttcactttctttcaatcctttgacacttttgttacattttattttaggctttttatttttctggtaagaaatctgctttcagtataattattctattgtggataatctttccctatggtttttagggttgttttttccttatctttgctgtctacagtttcactaggtagttattttctcctgtttaagaatcattatgtttcttgtttctttagaatcatgtcctttatcaattccaaagttttttttttagaggaacgttcttgctctgttgtccaggctggagtgcagtggcacaatcactcactgtaaccccgaactcctgggttcaagcaatcttctagactcagcctcctgagtagcaaggaccacaaacacatgccactatccctggctaattaaaaaaaaaaatgtggagataagtgtcttgctatgttgcccaggctggtcttgaactcttggcctcaagcgatcctcccacctcagcctcccaaagtgctgagattgcaggtatgagccactgtacctggcctcagtttcaaaattcttagccttattttttctgaatatttctttttttcacttgttttggtctccttctagaactccgatttaagcatatttgcatcttctcattttgccttattttctcttcccattcatcgtttctgtctctctttgctacattctggaaactttcctcaatctctttttcattcagttattttctctttagctttgtcttacctgatgtttgtcctcacctttgagtttttaattccaatgactatatttttcatttgtgtttccatttgctactcttcaaatccaccttttcatcgtgttctattattttgttagaactttaattattttatgtttaatcatttttaacttattttgtagtgtctcccaaattattgtagtaagttcaggggtggaaattctgtttcagaacatactaatctttacaatggtggctgtatgcgtatgtgtgtgtgtgtgtgtgagagagagagagagacagagagcgcgcgagtgcaggagctcatcttcattaattgttacattcatggaacgctcatgctccctgaactgtgccttaccatcaaatggtttcacctctgcttgtgctattgtcctgctggtttcaatggtttagagctggtttaaattaatttttcagattaaggagccctccaagacacaggtagcatttcagtgtcttttttttttttttttttttttttttttgagacagagtcttgttctgtcgcccaggctggagtgcagtggcaagatctcggctcactgcaacctctgcctcccaggttcaagcaattatcctgcctcagcctcctgagtagctgggactacaggtgcacgccaccatgtccagctaagtttttgtattttttagtagagacggggtttcaccatgttgcctaggctggtcgcaaactcctgagctcaggcaatccgcccacctcggcctcccgaagtgctgggatggcaggcatgagccaccgtaccctgcctctgtgtcttttttgatctcctttctagcgcatgctgtcttcttttctccatcaagcttaccttttcatttaaaatttccttcttatatttcacctagaatcttacgtccttgtagcaggaatagggtctgagccagtgtattctaatatgttgctaaaatcagatatatttaaatatattctctctttttttattatgaagatttgtctctatctgtaaaacttaaaacttgccattttagccatgcaacttagtagcattaattacatgcacattgttgtgtaaacatcctgcatatctatttcaaaaatgttttatcacccaaacagaagctctgtacctattaactcctctattcccacctcccctttcgccactggtagctgcttttctgcctagtgtctctgtgaatttgcatattcgaaatatttcacatattcgtccttttgtgtctggcttattttacttaccgtaatgtttgtaaggattgtctacattgtagcatgtgtcaaaaactcattgctttttgtggctgaacactatttcattatctgacataccacactctatgtatccacttgcccgttcatgtacatataggttgtttctgcctattggctcttgtgaataatgctgcagtgaacattcgtgtacaagtatctgttcgagtctctatgttcagttccctgggatatatccctaagagtgcgattactgaatcttatagcaactttgcgtttttaaaacagactcttaccaaaatgaaataaatcacaaaggtgtagcaccgcaacagcagaggtggtgagggtcttacatcatccctcatctgtttaggttaacatatatgatattcaaaattaagagcaaactgcttagtcctagaactgcccagttcttgtttcttattgctcagctgtgtacaccatgtctacccagtgtgagtttcagtggaactagaatactttgattgagcaagggcttgtgtgtgtattgtttacttttaaaaacattgtttcaagagggttttttgttgttgttgttggcttggggcttgggggtgatactgaaccaatactcattcctgctttgatacattgtttcctgagccttctcatctcttctctgcggcttagctttcattatttaacaaacatttattgagtgcccgtaatgtgctggcttctgtgatacacacagagaaaattaaccctggagtaacgtgctgagggctgcggtacaggaaagcacagaatgggccgtgcgcataacccggatgagcgccttgtgtcccgctcactttgcgcgttgggctgcaaacagtgaacactcactgaagttctgtcatgggatggaaaattcattgcacaaatgcaagtggaagcagggagggcaggattcttgggaatgacgccagatccaggagacgatcagcttggtctcattccccaccacgaacctcgtgtcccgacagcgtcgacacatcccttcatacacggctggccagatgctcacccgcagtccactcagcggtccactcagctgcgtccaggattgctgggtcatttggaaactgcatagagattcataggcagcttcccctaaaaagggtgatattctgatgcttagcccatctggtacagccaccattcatctcttccttccttcctttaaatattccgcaagtactcatctcaacctcttctcacacctaagcctatcctgataattgtcttttcctccaaatcctctttaatatatttttcatgtcaaaggggaaatcatcttcttttgtaagagaatacatgataaatttattttccctgtgtctcccggatgtctagagcgggagtcaggaaaaggaagcatttttggggggacttaggaggaaagaattcatttttttttttttttggtaccttagaatacagagacagtgatccacattagaaaggtatgggttggactctcctacttccctaggatgtttcttctaccagtgtgggtgacactggagttggggtgggccatcaggagatggaggtgagcctgccccggatggctgccccctgctcaagtgagccagggtgggaggagatgaggaagacagcccctctggctgtgccttttggcccccttttctctcagttgccctaaaagttatttattcctggagttggctttagaaataaataggaagtatcttggcataagtcagagaagggtccaaggcagaccatcttcagacgcagtgagaccctcatcctctactccatcatacacctgttttccattacggagttctgctgtcctctagttcagctctgctctccagcaggctctctcgggtggtgaccagatggccgccaataactccagacttaaatcctgcctgggctgcggggcggacaccccatctactgtgcaggcactgctgttggctcctgtggagcagctgtggagcaggggtgggtggagtagcctctgcccatcctgagggacctcctccgtcctccagttgtggcctctgctcaggttcatatggccacacagcaacactgtctaccttttatgcttctgctgatccctacctctcccaaagacagtaagctcgggaaaaggggacagtgacggtgttagtgaccccaccacacccactacagtgttgagcactcatcacatgtgtgtccgtggagctggcctatatgcgctctccagtatgaggctgtattatgtctaaggatacacaaatacacggctttaaagtaggaatattttttaatttactacaaagaagctcagggattaaagaaccatccgtctcttaattctcatggtcgatggctttatctttttgcatagcgtgcttgcctaaagcgaggcacctcttcatatataaatcagcctttttttgaataaaagttaaatacaacaggatggaaatgcagctttgaaaacctataatgagcaggagggattattatgcatctacaccccggggaagtgaatatttcatgttagaaaaagtagaggccaagggcaaggttcatttaaaatgtataaagataataaaagcgctcatggatggaaaggccatctgaaaggactgttcactttttggagaggctgatgtggaatcattgtgtttctttgcagggggaaaaagaaaaagtcctgtgtgcgaatggccccctgcgtggtgctgcgtcagcagacaggagcattattttcccctggaatgtgcagcgcttggtgcctctgttctctctgtagtgcacagagccaagcagagagagaggctgagcgtttcaaagagagacaaaacaaaaacagattattctgctgtgctgccacatcaccacagcacaatactctgttcaaaattgtctcttgtcaggcacattcttcaaacagtattatgtgtacaaagactctctgtgttggagaatttgcatgtgtagggaaaatagctgcatagtgcggaatatttcctgaagaggccagatttctgtgtgtgtatgtgtgtgccgggcatctgtgtccttagcattttggaaggtgcctgagctttcggaggtcaccaaaaagtactgagtcatcgtgccattcggttaccttcggcgctaccatcctagtctgaagcttttacaggcctctaagaaggtcttcctgagaccccagtcttgttttttgcataagtacgctgcccaggctccggtgattgacaggtgtagaatgggacgtcctcctttcccagttgcatgatacatagtgttcagtgttaatttctggaattcaggtcacttgaaaggccaattcttgggcctttctgcctgaatggctgatgattcctctccttgcatccctcgtgatcaattatccagaaaaactgattattcagattgttaaatccccagttagtccggataatcggcattctgttgtatcccataaatgtggcccacgctgtggagcagggtgggcctcttcctggggccctgtggctcctctctccccaagctcaggcgtgctgctctgtctcccgctgcctgctcttctgggcattccgctctcctccagcgccactgatgcacagcctttccaagagggtggccttgcctctgggtcagctctccattttggggggactagggtggcccggctggaggcctctgcagtctttgtaactgggacaaaagttgaaaggacacataaaaaaaattacagataaacctgaaggcacatgtgctcacatggctgctgtggctgtgggattgttccttctgcctgtgaaatggctgaatttaaaacccatgcttctttgtcctctagatcctgtacccccactttaggaaggggcagcaatcagaattaggcagcctactgtctttgttggggggctgtaacaaagtgccatagacagagtggcttgtcagcaacagaaacttactgctcacagttctggaggctgtgaagtccaagaccaaggcaccagcacattcggtgtctggtgagggctcatttcttggtttgctgtgtcctcacatggcggaaagggcagacgggcttcctcaggctacctgaggaagggcactaatcccattcacaagggctctgccctcctgatccattctcctccccagagctccacctcttaatgctatgaccttgggtagcaggtttcaacatatgaattttgggaggacacattcaaaccacatcacctgcccaaggtcttacagccggtggtagcccaggccagccatctctttactgtacccattttgtctctagttctgtattaggtgttggaggagggaggtcacacagatgtgaaaatgagtcagctgaacaaggagcaggccctgccctggaggagcttaaggggaaattataaatttccctcagtagtgaatcatgctataatctagtgcagggtgcaaatatgtgacctgagggagctggataaagtactcaccttgctgtggagacgtttgacttgcacctggaaggatgactcagagcagagatgaggtgggggagggcattctagggaaggggccaacttgagcaagagcttgtaggtgcgggggcgtgcagggcaagggggccctgttcacttagaacaaaggatcggccaaggaagtctgggaaacaaaccaaactacagaggagcttgagcagagtcgaagtttattttgttccctcgttgaaggtttaaagccgaggagctacgtgatgagcgctgtgttttaggaagaggactccgtaatagagaggatgagccagtggatccatttctaaatgtgtttcttaggctataggaggaggagctttctttatttattccaaaatttgctttcagatgctaatgcgtgtattgtgaactctgagaagagagagttccaaaatgtatttgaccacaaaacctctttttcacggtaactggtgcacagtaggcactcagtgtttttgcatgaccaaataagcaagtacaacaccagcgtgccacagagtgtggttcaagaaacattgcattctgtgaggcgctgaagcaagaagaaaggccagtgagaggctttgatatttatccggggaagaggtactgattgctcaagctaagcttcagtggactgaagatagggaagccaaccacccacaactcctccaaatacctccctctcccaggcaggcatggctggggcacccgcttctgggctctcctgccccctgggcccaccccacggatggcttttcatgcatttacttatcattctcctctggcagagaccggcacggtctggcccgtgggggctcaagacagttgacagaaggaagaggaaggagacctaagggacttggcagctgggtggagaagaagacccgatttctttatttatacatggacttgcttgaaaaagatttctagtccttaaccaaaaaaaagtgcagtgacctttccactacgacatctgttcccacgagatgcaagtcacagttttcatgtaagggctcaaagcaaccgtggagggccgaaggcaagcaagatgtggatcaggctcttgtttttctcttctcttcatcttcccctccccttctaaagtgagagcttgtgattaaggagggtttaatgacagggaaaacagttaaaatgaagaaggagttgcctgaaggaagcatctgggaggtgggcagagcaaggggtaccgggggccctgccatgaagccttcagggcatcggtatggaaatgcctccagctcctggctcgcgctaagcgtacctggttctctagatggctcccggtcttcttgcctcctggcccttccctctcccctcctctgacctttctcttacacttatctttttttttttttttttttgagatggagtctcgctctgtcacccaggctggagtgcagtggcacgatctcggctcactgcaacctccgcctcccaggttcacgccattctcctgcctcagccgctcgagtagctgggactacaggcgctcgccacaacgcccagctaattttttgtatttttggtagagatggggtttcactatgttagccaggatggtctcgatctcctgacgtcgtgatccacccgcctcggcctcccaaagtgctgacattacaggcgtgagccaccgtgcccggccctgttacacttatctttattcccctcatccattcttttctctggactatgttagtgctctggtaacatcctttccctcattcaatcccaactctcctaaacccccttgagtatgttcaccagtggtttattgacatccatctattcttgttctctccaagcccagcaaaaataagaaaacatattttggggtagacagatgctgacccctgacaatttctctttgattttcctccacattttctctttattttttgcttcactaacctttaagccagagtaaataaaaatgactggagatgactgatttgccccagattacacattaagttagtggtgatactagcgccagggcccagggctgactctgctataccatactcccttccctgatggtgcctgcttttctgaaagcttcttgccctattataaaggaagaagcatctactccagatgttgaaaaaggtaaggagcggttatgaaggcccagccctggggatagcttagcattttgcatttagtgcaaacccatttgcagcttttcctcatatttggttgaaagcatttgcattatacagttcatttatgcctttatcataattaggtgcaagttgctgctgcaatatgcttgtctgcattattaccgtacttgcctattttcattcctgctcatcctacgttattgtgtcttactgggttcatgtcaaatcttttcaatgtgtataatattctgctttcggaaatcaggagggggcaaagattgttatgtcaaaaattcagagaaaatgaagaaatgtgtgtacatgtgcacatatagagagaaactgcattgaaatcacagcgagattgtggcagaaatgagaaaacctaagattaacggcttagagggtttttatgctcctggaactcagaaatggtatgtttgcagttgctgcacaaacatggtctaattgctgaagctatttttaaaaagcacgctgaaaccatgaagctagggaagttcaaaggcttgctcttgcatgtgctcagtcatctttcccaactcttattgcaaaatgattttttgcttgaggacagagtgttgggtatctgtgacagccacggtgacatgggctgggaggtgtctccagagcagctccagcagatccctgatggcccactgggtaattaaaagctaagtggaatgttgaaaaaacgtccatacaatttgatcggtcaatttgcttgcttttttgagaatttaaatgagaccttcagaatcatttgaacttttaaaaggaaatcatttcaaaagtcgtcgaaagcgagtgtgtttgatgtgtcttaagtgacgggcaagactgaactcattttaggtggttgttgatagtatggatgcagctgtgaaacttgaatcagaatcatgcgccatccttcagtcaactttgtaaggcacatttctcccggaaatcccacaactgttgattattctcttgtacggccgtggaatctgagagctttcaattagcccctaagggcacgagaagttgagggtattttccaaataacagggtctacatgcaaatgacgtggtaggagcaggggtaggatgagccagagaaagctggagcctggcttctgccccattctctccagctcactcgctgtagaaagccagtggctaaaggcccttgttggagccaggggagtctttggtaggagacccctgaagagcatgtaccctgatgtggtttggctgtgtccccacccaaatctcatcttgaattgtagctcccataattcccacgtgttgtgggagggacccgtggggaggtaattgaatcataggggtgggtttttcccatgctgttcttgtggtagtgaacaagtctcatgagatcggatggttttctgaggggtttcccctttcgcttggccctcattctgtgtttcccacctccatgtaagacatccttttgctcttccttcatcttacaccatgatggtggggcctccccagtcatgtggcactgcgagtccattaagcctctttttctttatgaattgcccagtcatgggtgtgtctttattagcagcgtgagaatgagctaatacatacactaaccaagcaccctctgtggctgactccaagttgtcatggaagttgataaagtacccttgagagcttagtaccaagtcacgtgctgactgactgggttttacacgtcctagccaccttccacccagaccactgtatccaaaacctggcctggccacgttttggataactttttacttacttttttatttagtgaactacagtttatttgatcattcttgatcactttattaagcggaaggagatgttaatctctgaaaagtctatccttttacttccctaaaccaaaaagtgactggagcagatctcaatagatgagaagtttattttgtcaaggttgagggcacacccaggaaaaagaaacacaagtcatagtaggatctatggcctgtgctttttccaaagagggtttttggaacttcagtatttagagaaaagaacaagcaagagtagcggggggtgggaaagagggagggagaggaggcaatgaggccagtggtcacattcctgtgaagccctgaccagccctcagtggatctacattttacatgtgaagaaagggaatcagggaaagtcaattatgattctctctctgcttagtaaatctacactttacatgagttaaagtaaacatgtgacatcatagctgtctgtttgggaacaaaaggaaggcagtgttttgcatgactcagttcccagccctaacttcccctttggcacagtgagtttggggtcctgagtttctattttccttgcacacgtcttagtgctgtgatagaaaaggggtttatttgaactcttgccatctttgtcttaaaagatgatggaaagtcaactgtctgtggatgtgataggcaaatcagttgttttaagcaattcttaggtaagatttaacatggcctcaactaattacttaagagacagctaggaattatttctgtttgcctgtactttgcctctgtatgtgtgtgtgtgcattgcatttctagggaaaatattgaatagcagtttcttttttgaataattatgtattagagaaatttagcaatattcttcccaaattctatatactttacattacccttcattttaccttccagctgatagaagagggaaaattgtagattattaattgatagatagatagacagacagattgtcagggagatggatggatggatagatagataatagaggactttagcttatatagcaattcctgatacaggcacagatgcagactcatagtataaagttgcttatcatggcaagtgcctgacatttcaccattttgatgactattctaggcccaaaagctcacagactgggggcaaatcttttccatctaaaaacactcccatcatcccttaacaaactgatgacaacataattgttttctatcaaatgaatcctgaaatagtataaaacatacaaaaattcagtctgtttcatggagcatacaccttcaaaattcttttcaggcttatttttgtcactaaataaaaatcaatcacttgaaagcatacgtctctgatttctatcccttgtcttataggcaggtgtctctatttccaagtcagcattcattatgcacttagctaatatttattgaacctctgtgttctgttggtagttatgagtgtgatgcaggggtggctgggatatcaggtgtcctctttgagggtttctctccagggtagacgggaagcctcattgcatccagggtacagaaaggtgtgacagattccccaagacacgggctgcactttggggcactgtggaactcacaggtgagcccctccctgtgctcaggggcatcaggttgtccttcaggggccagcaggtaaaacggactctgagagcagaggcctgctaagaaggaagtgggggtgtgggcagtcaggaagtcatggcttctgtttgagtaaagcctgatgaaccacactccttacccagggttagaggaacgtctatgggaccagctgtcaaattaaaagcataagtcacacattctatttccagagcccacaaggaggaaaaactgagacttcctagacatgaatttcatttctgacaggcttctctcctgctacatacatgcacattatctacacacatgcacatgtatgtagatagcgtggcaagtgcatgcacacacaattctgcacacacacctcctcctgcactcaaggtttctggtctccatacaaagatgggaagatttggggctcagggattttgatcaaaccctcggtaaagcagaaaccacctctgttgtacttctagttttctgtttcagggcccaagaaagtccatttcaagggccttatgtgtaattcacagttttgttggagtccccttctaggtagacaaaacagaggaacctttcttagactggatctcagttcagccatcccaggggctaccctctcacctcaaactcaacagaagatcaggaatctgggggtagcatgggccacgtgtcttccctctcaacaccgcggtaccctggagcaggggttcccaacccccccagccacagactggtatcggtccatggcctattaggaaccaggctgcacagcagcaggggagcagcgagtgagcaagcaaagcctcatgtgtatttacagctgctcccatcgctggcattaccaccagagctccgccccctgtcagatcagcggctgcattagattctcgtaatagcacgaaccctattgtgagctgtgcccgcgaggcatctaggttacacacgccttatgagaatctaatgcctgatgatctgtccctgtctcccatcacccccggataggaccgtaattgcaggaaaacaagctcaaggctcccactgattctacgtgatggtgagttgtataattatttcattctgtattacaatgtaataatcatagaaataaagggcacaataaatggaatgcacttgaatcatcctgaaaccatccccccgacattggtagaaaaactgtcttctgtgaaaccagtccctgtgccaaaaaggctgggaccactgccctgaagcactcaggagacacctgcatgccactcaggtctctgcaggaaatgacgctggaccggcggttctaccgagagacttcctgtcttagttggccccatttatcctctgacggtttcccacatacatggcttctcacactctattcttctcatggacatattcgtgccacttgcagttccacatttcactgcttttcagattgatgtgttaccggagaattattcttctatctattattattataacattcaccataatcatcattagcccattaactcataactattactatcattgctaatataatgactgttaactaaatatgaataatgtatgctatcactaatataattactattattaactatattccatctcacataatctatctcagctgcttcatctccctctgcctcctttcaccttccccctgcctgatgttacaaactgaacaacttagagttccttgaatattccatgagcccggcttctcccccaggccataatgagggtatgtcagtgtgcagtgcacaattagttcctctgccaaggcaagatctggggtgcatggccggccttgcagcccgtgtgggtgtcccagtcttgctcttgctctttaagtcaggtgtttgcctctgctgctgccatgggaaccatctactgctgcaggtcaggcatcagaaaagttgtgtgtcctgccctacacccgtcaagtgacgacagatgacaattggaggggaaggagaggaggtcagaggaactggagttgcactcgtaccctccctggtgaactgaaagagcaccctccctggtgaactgaaagatagacaatatccataatgtcgaggcattgaccaaaatcttaccacgtgttttgtgctccatagaatctatttcaatggagcaccggctcttagagcgcttaaagattctgctttattaactgactccatgttgctctactgggccctgtggagtagttaacagctgttagcttgaaagaacgtatggttttgttgggaactgtaaggtgtaattaattcattaggacctgctacatgtcagaggctgcgtgagacaccgggctgcactcatacctcacgtctcagacacagacttggacctcagggaggtcacatccctctgaggaagagaccagcaaaacaccaatcagatgtgaccagtggcactggccactagagtaagcacctgggctctggggtcacagcagagggggcaccaccagctctgggaaggctttagggagtggatggcaattagaactttcaggatgaaaggatgtggttcagaggactgggggagagggcagcacagacagacgaagccacgtgcaggggcactgagacagctcaggaatggcggtgagttcacccccaccgggtcgtgtccgggaaaatgatggagagcagcactgaggatcagcaggggaagatcacgctgtgcatcctgagtcttctgggcttcatgctgtgggtcggggtgattcgttgaaagatcttagcctaggggtgttttaggaagatggcacaggctgcagcatgtagaccaatctgaaggaaagatttgcagtcttgcaggtgagatgtcattaggccttggactgagacaggagtggtaagaggggaacatacttgggagtctggggggaaggtcaaggtcaaggtcagcgggatttatgacatggtcatctacggggagaaagagccagggagtagcttctaagactgtgtttctagctggagtgactagaggagtgagggtgatcttttcagagctcaggagtatgtaaggaacagattaaggtgggagggcaggaaaaaagacaaaacagaagttctgcttggattcgttgcattctagctgccaagatggaactatccggaggcaaggcggcacttaaactgcaagctggggctgcaggtggagattcgggagtgactgttttaggattaatttctaatggcctcagataagatgacccagggtaaagggagactatgcagagggggagcagtgagagtgaagaggaggataaataacaatagatggcattgcatgggacataaagtgactgctcggaggttatttacgggaagatggatctcgcaattgagtgctgaagaaggcatttggtaacaactggagccccttctctgtgccaggagcgggcactgaggggcacaagtgattaaataccacccctgccctcaaatgaaagccaacatagaaacagataaactatagatcaagtttgcaattcctagagttgagatataaactaggtactatgggaacacagagctcatttttcttttttattagatgagcaataagtgttaaatgtagaaaaattagaaaatacagagaaacagaaaggacatatatgtaactcataattctacaacccagacatgtggctatgaacattttcattcatgtctcatacaaataaaaaatacattttttagcaaaatgagatcatacagcacacactgttttgtaaacatttttacttcatattttattatttctgtagtattaactatgttatcattttcaataactgcctagtttctttttttagcaaatgtatcataatttattaacctgtctccatcattggacatttagattggttcctggctttcaccacattagacggaatggcaaatattcttgtagctacatatatgcaaacatcaacattatttctttacaataaattcccagaagtggaattgttgtgttacacgatgttctagttaagctctttagctataagaactagacctctcttctctatagacttgctagctccagcttaaaagtagagggaggggatttttatgaacaaaaggaaatgagggaatctaaaggcgccaagaagctgattcctgcaggcctgttgagagactagaaattaaaactccccgggccaggcacggtggctcatgcctgtaatcccagcactttgggaggccgaggcaggaggatcacttgagcccaggagctcaagagcagcctgggcaatattaccagaccccatctctataaaaataaaaaaaatcaggtggacatggtggtgcgtgcctgtggtcccagcttcttgggaggctgaggtgggaggatcacctgagcccaggaggtcaaggctgtggtgaaccgagatcacaccagtgcactccagcctgggcaacagagttaggccctgtctccaaaataagtaaataagcaatgaagctccctggattccagcccctgttactcaggagccgcagggcctctcacccatgctcctctgtgcctctctgccacccttctcttctttaccagcctggtttgcttacttcttttgccataagactcaattttatgtcatggcccctcagcttcagtggctgacggtagtctctgccttttagttaagacgccggagaaggtgagtctgattggcagattcccaccagtcctgagttctggccagctaagctcgggcagccatggatctgggggctgggagcaggattcagtcgggatgtgctggagcccacttaccccagctagtgagagctgaccctgggcacctcctcccagctccaagttcactgacgtcatattgggagcttgaaatcggctgtgccggatttacttacagcaagaaaaccagtaagtgctgagtcagggctggtcgtgagatgttcctccgaataccactgggtgtcacatggaacaaaactctctgactccttgagaaatgagtatggccagtgactgacatctttagaatatttctgaaacaatgtaatctcattaacattccgtagatgttacttcattctgttattgtgtttaatgtcccagagaagaaatctagttttgggattttcatttcttttctttagattgatatgttgttttatctgtctgcactcttgtcagtttgatttgcttacaaagcgtgcacgttttactgggctgcaactgtggtggggcgctccctttgctggttctcagtaagtccattttatttgaagatgcaaatctttttccaagtcggggaagtttttccacgttgttaatttgattaatgtgtttctttcacttacagtgtattcaccttctggaattcctactgtgcttatatttgatcttttgggtcaatcttccattttgcttatcttttcctcatcatagctaacttaatctattttctttgaattctggagaaaactcttgattccagccaggttcactgatttgattgtatgcactatccagtctgttctttcgagcttctgttgcattgttaattttggcaattgtattctcatctgaaagtagtcttttctgatctcagatgattccattttcatatttacagtgtgttattgactcctctcaatgagttatttgattcagattctctggttgatctcaagcagtgtaattcagaaatttcttaaatgttctgtttcataagggtgatatttctttatgttctttaaattgatcccattattatggacttttttttttattatgagctttattatcagggctacttcacttttattttgccacattaatgaatgtgcaggctgtattgagagcctacagttcactgcaattgaatgaagggaggtttgttacggggctaaaggaattcctttccctgtttgttttaataatcgagaagttgcccgggctctactcttctctcaccagcacttagtgtgctcaagaggttctctcaatggagcccgggactggcagtgtgggcatcccctgagtacctgccagaaatgcccggtccagaggcaccagctcagaaactctggtatggggcctgggaatgtgtgtcttcacaagtcctccaggttggtgccatcaaagtttgggaagtgcctatttgctcaccactgggcttccagccacagcaagggtgagccaggtccaagttcacgtttagtcccctcatggcaacatctgtgcactttcacgaggcatttgcagatttgcccagcctgtacctcagccctcaagctgctcctacccggaattctgacctctgtggagtttgcagggttcctcaggggttcctttcacttcgtgtccaggtggacttgtcttttgcgggtggggaatttcaggttgggcagcctctcccttagacagggcttgctcatgctgtcctgcaggagctccagtgtgggtggtcgtgattttgattctcagcagaaatgcagactatttccctactattttttctttggatatttctatagagatttaggaagaggtgcagaatgggaggctcaaatcacctggaggcagaaattcctctttttttttttttggatgacctaagggagatttacagagtaaaggggacgctgttgtaaccatccaggtggggatgaggagggtctggcattggggatggggaaaaggtggactcctgagtatttctgagatccagtggatcagcctgaggagcagttgcgtggaaggagaggatgagttaggatggctcagttcattcagttacagtgaactgtaggctctcattttctagcgcagctgccctgatgacttcttggaagacatcaaattgtgtttgacttgggcagaaggatggcactggatgagtgaatggatggggtggccattcccaaccacagctgagcacgtcgtggtgacggggtgtgatctcccccacccctgctgcacccagagctgtcctggtcacatgcacattcactgtcagacgacaaacagggagaatgaccgatgctgccaggaattctgtttgggtctcgtacgttatcatctgttaccagtgacagtagtgtttgggacatttcgccagcttcccggagaaacagccctttttcctcggcctcccggcacctgcagtccgtccgtagctttcccacaacccatccctcagagagttctggcatgctaattttcaggtttaccaagtggcatgaaagatactaatgaatttctttacccgtcgccctcctcctagctgtcatagctcttcccacttgaagtgtttgttttccttgttcctgtgtgtgtgtgacagaggtgaggggtctgctgccttcatggtggacgactcacttgtctggtgcttcaagcctggggtctgccttcctaataatggccactgtcattttcccccagctggaggcctgaggacatcagcttaagcctctccagggctctgggacctgcaaggtccagactcttaatgtgattcttgacaactgatttgtcagctcattttccccttttctcaatgtcctgttgtagctcagtctgtctgcttgtcctcagcgtgtaataaaacaaccccagacaccccactccaggaaccagggccccagagctgtcccacagcctagtttaggactgaagccccagatggcaccccctgccattgggaactctaaggagactgaacaggaagaaacacagagcacatcttccaggaagaacctttgataagctgagaactctttgccctttatttaaaaagtaaaaagaagcgaggaggagaagctgcgtagaagccctgccctctgagtttgcttagaaaaagcacattcaagtttgcatttaggaatcgcagtcagtgacgcatgcttgggttccctgctcaagctgttagggcaaaagcgacggcgtttctaccctcatcaggagagactgcctctatgaatctctcgtcgccaaactaagcagttttaatccagatacagagtggagacagatgaacgcatgcaggatgcttctccagagacggcgtgttctcgctgttgtcagccatccagacagggtgctcagagggcagccttggggcaccctgcagtgggcaggcagcatgaggcacacggatccttccttctcttttcagctgaagaaatgctaaagagaagtttgtaaaattcagagcctcatctcagagggaaagatgagttaatgatctgctgcagaaggacttggcaggtgcgtgctccagccggctgagaagacacccacgcagccctcccaccatgctgaaaaacatagggtcagccattggcactcccccttttcccattgatgaaacggaaattatcttttggaattgtgctgttaacaatactctgtattgccacaagtaggtttttgcaatatgttgaacaaacgtgttatcccttttcaggtcctaaagtaaagagggtctcaggagggtgtaagggcagcacgtgagagtgtggcctgtgaggaggatgttgagtgacttcagggaaatcagtgtcacctatgcagagtcacaagctggctttcctagtcttccagcacctggataaatccctttttgtgcaacaagcactgatggagtctacagaagcatgcattcccgtgggaagggcatggctttggtgctgagcctctagatggtacagacaggcatcagggaccctttggccactcatttaaaccctcagccagaaggaatgaaatcactggggctgtcatgagcaatgaaaatgacaatctgcactttatagacacttagcatagtgtctggcatacagtaggcacccaacataccttgagtctgttatgttttgtctatcagctgttacatttgtttctattgtcttttctccagttttctctgggattggttagagtgaaacgtcatgaaattgtttttattttattttaaagacaggatctcgctctttcacccagtctggagtgcagtggtgtgatctcggcccactgcagccctgacttctttgggcgcaggtgatccttctgcctcaggctccccaggctggtctcgaactcctgggctcaagctgtctgcccaccttggccttctacagtgctgggattgcaggtgtgagccaccgtgaggtcctgttttgattttagactcatcccttaaagcccaggctgtcacataccagccaccactttctacgactccgtaaggcacggtggttcagaacacaggctgtggcatctgcagacctggctttgtgttcaggctcaaccacttagcaactgtgtgacccaggccacatcaggcttcttacctgtaaaacaggaaccacaggccttttgcatttaggggcaagggtaggcagatgccacatttccagcaggacttatgggacatgaacttaataaaagtctgctccagtagcctgagcacctttagggcttaacttgggggcccgtcaatgcctccaccgcgctctcagccacagaggaattcctgaactgtccaccagtggggttccgttatttcctgtgatgggcaggtagggctgacactctgttctccagtgtagatttcatagtttggatttgggcggcccagaaatagcctgcgagatcttactgaaccaggtctgacgtcatcacactaaatggaaaaaagttaggaacgtgctggtattccagaattcttttcttaaaaaagtaacgttccaaagcaaccatattgctaattgaaatagaattttttttttaaattcaggaaatgttgggccctttagtttccctcctatttttcattaggtattttggagcatttcatttattgagcacctaccgtgtgctggctgctgtgttatatgcatcgtacatattttgttctcacaacaactctggaaaataagcataaccccttttctcctgtagtaaaggggaacttggaaggaaacagaagcctgccagggtcagagagctcatgggcagccaaggcaggacttagacttcacagtcagaggcctcaaagcctgcgcttctcccgtgacactgtcatttcagagggtgatggtccaccatggctgaagaccaaattcagccaacagctgctgcagccaagagtccatctgtctcctctgacactgtcatgtccaacctgtttgcctgaacatactttggccactttggagtattctgctcagaagtaaaaataatgtcgtcaaatttcataaatagatttctgaggtatatacttctccgcaggaacctggctcacttactgtctttagataatggaaatcgtggttgcaactgaggttctttcctaagttaacaaatggttgttcctcaccgcagaactacaggaatgacccttacaaatgagcagattctttgttttctcttgattgctggcagcagctgctgtgggtgctcagtagaggaatgtttagtgagagaaactgagctagtgttgcagcagaggaaaaacactaggaaattgacgacttatctttccatttgcaccttcagaaataggttaattgtttcagtgactgcctctgtcttgattaggaagcattaatagcaattaatgatataacttcaaaaaaggtataggaaaattaatagaattctccgttaatataaattatactcattatctactgtatccagaaccatcaggcctgccaagctcgttgattaaagtacaagtggagttttttcggtctgaattctctagatagttaaacctttatttatttatttattttgcagtataaaattccccacagtgagccaatagtattatttagtttaaaatccctcaattctacaacttagaaacctttcataagttaattttattaatgtacacacattttatctacacgtacaaatattatttgatggtaatgatgaaactttgttaataaaggatggtgaagaaaagttcaggtcaaaaaaatatgaaattgtaggactgattttatctagctttaattctactctgcagtagaaacagaaggcttttttggtaggcagacgccacatttccagcaggacttgtgggacttgaactcaataaaagtttttttttggggggggtgggtggaatgccaataatggtaagaataacaatagcaacaatgatagcaaaggcaataaccaacatcccctaatctgcccctaggaccaggttcagtacctcacatgcattctcactaatcttcacacttacaggaatcttcaaggtagagggtgttaccccgctttacagatgaggaaactaagtcccagaggtggtcaggaactggctcaaattcagacagcaaagtggcagagctgagagtcatgcccaggtggggaaaccccacgcgtgcattctgtcactcggctgaactgcagcacagccctgggcttattttaagaacataaaacctgtctcactagacccaactctctgccctgttccttattctttctcagtgtcaccagaggacacatcagacacagttagccttccccatgtcaactctagatggagaggaatgcccctcgaaggagtctaggctgcctcaggattttactatgggtgggaaaccaatgcatttgtccttgcccttggttaaacggttatctgaagttggcttatattcatcctcttaccatccttaacagcaagcttgccgccaaattccgtcactgattattttgacttgatgaagcgttgctcttgatctacagattcctcggtgtgttgtggactttgatcgcttggccagctgtaatctgccagcttgaacacgattgatcttcatgcaccaggcactcacacctgcccatttggcggggttgcttatgtctttctcacaccttctagcttgttctttcttttctggagatccaacaatcagaaaagcattccgtatttattccttaacttataaggaacctataaatagggctcctgtgtttcttttcttttccccaagactgtgtttgaaggttaatttcaggattttcttggcatccttaaagcggtgggactgttctaaactcctttgaacaaaatgttgattgaagtgttatcttttgtaatatactcctggagggttgtagggatttggaggaaaggtcagagtgatagggagtgttttggaggaggtgagatttgatccagcccttgaaggatggtggggtttgtggtgctagatggctgatgaggtcatttgtagataggtggagaggtgtattagctggttttgcgttgatagaaaggaatacctgaggctggtaatttataaggaagctggctcacagtcatgcaggctgttcatggtgccagcattgctcagcttctcttgaggcctcaggaagcttttacccatgatgggaggtgaggggagccggcgtgtcacgttcctgaaagcatggtgtttttattttttatttatttattttctttacctaattggtaaacaggtgaatgcagttctacttggagactcagcccacccagcacagaacttctcacactgaatgagaaggcgctgaggtgatgtatgtgtaacccaggcagctcgttaacatttaggtcctgattcgatgggtctggagtgacacccactgagacttcgcctttataaccagctcctaggagaggtctgtggtgctggttgttgctccactttcaggaacaaggagctgagtaactcaccacgtgctggaaaacatgcccttttcttcgaataactcagaactagactcccagagcatggccagagccctggcttcacctgggtgtggagtggaaatgcagggtcttgattccaccccagccctgccgaggcagaatctgcacttgaacaggatccccagctgaatcacgtacacacacaagtttgagaagcactgacatggaagaggcaggtctcaagaataccagtaaagccagacgtggcttccagtaatgaaagatacaggtctcaagaacagcagtaaagccagatgtggtttccagtgctcagagactgaaaatcctggcatcaaattaagctaattcgtaagtgggttgaaattaattaatcagaaaggacaaaatacaaaaaaattagccacgcatggtggcacacacctgtaatcccagctacttgggaggctgaggcaagagaatcacttaaaactgggaggcggaggttgcagtgagctgagatcgcaccacttcactccagcctgggtgacagagtgacactctgtctcaccgaaaagaaaagaaaagaaaaaagaaaagtctctctgagtaaaataagagttgtactaggtttggaacaagaaaagatatttataaatgcatttaagatttgtattttcagcatcagttagaacatcttatctatagccatttcttagaaaagtctagttgtaaaagaacagtgatttttgcacatcttgctgaattatttttatttatgtaaataatagcagatggacatgtataatcatttcttttctaaataagtgtgcataaaaatgaagacattggagagcacttctaatccgagagacgttataaggattcagccaaagacaggatccttggggcttcggttcctaaccagaggggcaccccatggacgagcagatcaacccattttaattttttcatgtcttaagtaaaaccagagcttctcaaatgagaaattcacaaccaaacacttaaaagtggtagtacccagaatggaagaaatattctatcagtctggggcattttctttcctcacatattcctaccctaagtgcaaatgttcatacaactatattgatgaacacttcctctgccatggttttagatgatcaatttcttatttgtgtcatctttgagaatgacagactctgaggttcaaaaccttatggggcttctatcctaaccaacatcaaggaactataagtattcaacgtcccaaaacaataaagagtaagtaaacaactgcgtagctaaccaagtccctcctttgttctggaagaataattttgcgggaaatccttgctttctattcaggcatgtggggtacaccctaagctccttaaactccccgccatcttcctcagtgatatttgctcagcatccctaggttgattggtctatgctgtggatttgagctatgctggttaccaaagtgcctagtttttttctctttccctctccgtgccgacttatggggcgttttacttcttatgtatgagtttttccataggttgaacagagaccaagtgaaatttttaaagaaacaaatgacgctctcctattagaagctttgggagaggtttggtagaagtgcctattgtaattgacttgccataattacttttggattttctataaatttgctatacagctgttattcatgctgggcatcaccctgctttaaaacggcatgagttgctgggtgcctgaaccactcttactgttcattggtttggattgatagtttgcacagtccagatttgctgagtaatcattgacctgccacgtttttaataggcccacactgaccagcttggttcttaatatatttgaacaatcacataaatggaattaggacttcattttttattcacctgccttccagtctatgtgaacagactacttatgtttctagcagcagtagctcccccctcactaatgcttgtgataatatgcccgtaagtgagtatcttaggagggatcttagctgtgcttttgtgcacttcactccacacatacagcctccgcctggtgctccctccctctctctgtcgtcaactttagatttattgtcagtgttgattttcaaccaaaatatagatgagattgtgttgacatttaggaaaaaaaccttgcttcgtagcagattgagtagagaaccagttggtttaaatagataaccttgggtcatatcagaaaatgccttgttctagcagagtactctattcttgcaccgtgggactgactttattcatttaaaggaagctggggcagacgggaaaagaaatattttcttctctgaagacttcctgatttgtttgtacctctgttgtgacacccaagggtaagtctgatatagcggtttctaacaaaatgaaaagagatgggaaaacagaagaggaaattcctctccagttgtgaattatcgttcttcactatcaaagcatccctgtgcctggctcgttctgtggccttgttttctctgctcctggtccaaaacaatgacccacccattcccagagatagacaggagagaacaatgtgtacacaaaagagagggacagagagacccccaaaagaagccaacacccacctctgtctcacctgtgtgttcagatagggtgtggccgattgtgctgagcctgattatttacgcttctcagaatcagggctctccactcaggacagtgaatccccaaagaggctgagcccagaacctgccctgggggcagctggtgccaccgtgctggtagacgacacagcccagccaaagccacctggagatgagggtagcacaaatcctctctccatcctccgcatcctccggcgggaaatgctcctggatctttttttttttttttttttttttttgagacaggctggagtacagtggcttgatcatagctcactacagccttgacctcctgggctcaagtgatcctcctgtctcagactcctgagtagctgggactacaggcttgcaccaccactcccagctaatttaaaaaaaatgtttctagatacagagttttaccatgttgccatggctggtctcaaacttctgggctcaagtaatcttcctgcctcagcctcccataatgctgggattacaggtgtgagccgctgcacccagctgatcctggtgttcggacacgggatgctgttccattcctggagctgttttggaatgaacgctatcaaaggatgtggttagcttcagttgtttactgctcctcatcattttggaacattgagtagtctgtcacttgatgttggttaggatagaacccctgcaagattttcttcctcagagttcatgctcctcaaacttgaaataaacaagacactgattatctaaaagcatggcagaggaagtgttcattgatatatttgtataaacctttgcatttaaggtgggaatacgtgagaaaaaaagtgccctatgactgataaaaatatttcttctgttccaggtactactgcctttcagcatttggttgtgaatttctaacttgagaaggtctggttttacttaagatatgaaaaaataaaaaggggggtgacctgttggtccatggagtgccctttgtggttagaaactgaagccctaagaaacctgtctctcaaaaggttggcgcttggttctgtgtgtttttcccatggctaggggaaggtgtggaagagaaagctttctgtttggtgttgttcctgttaagaaagtcttcaaaatgtaacaaacagtcctgggggcattcaccagccgcacggcatccaggcaggcctctttgtaactagacggtgaatttaccttctgcctgaatagcggtaatttctactctgtgagttgaacagtggtatctgtagcaagagaaaataacttcaatttagtcaggttttctaaagatcttccttgtattttaaggaggggccataattgtgaatttcaagatacactttctgaacagactgtgacccccttccctcttatttatctccttttttctttctctcctgtgttcaaaccatttgttaagacaattttctgttttctccagggactggggattgaatgtctttgttcttggtttatctattaaagacacttttctagttacagatactgtttgtgaatcacaggctatgcaaagaacatctgattatcagcggactggagcccagcaaacagtcacaaacatcccagagctttcctgcctttctgaaaatgtgcatgcaaaattcttgacatgaggaagttgtaggaacaggtgttgatgtctatttggaaagtgtaaagttacacttatgcaattttagcaaacatctattaggcacttactgtttgccagatgctctgaagcatgcagggatccacaagtatcacgtgccttccaggaatttgcaaggagtggggccgataagcacgtgtccaaatgcgcaaggctgaaagagatgggctcttgtcctactttccccagaagtagagcctgtgagctcaacaaagatgtacgtgcaatagtgcactgagcggtgaccccagaaagtgtgagtagaggagtgtgcaaaggacacagcatggaaaggcactggtgagctctcatcagtgagcattcatcagtgtggtgagcagcgaggttcagccccgaggcaaccccagggagactgtgcaaagccccttcggtgttgcttacccaaggaggggaggaagcctggatatttatgcatcaactcccctcttgtattggcaagaacaactttgagagcattcttttctgtctgtctgcctcacctttgtaagccggtcatatctctggccacagaatggcctttggtaggaactgatgggtacttgcaaaaagccctgggcctgttggtgaatggtgagtgccagggacgatgggcagggcacaggcagcacctgccacaaagccatattaacagagtgtagcaggtgcaccccacacctgacaccgtgtacaaagcttaatgcaaaatgggtcaaaaacctaaatgtgagacctagaactataaaactcctagaagaaaactttatgacattagatttaggaatgatattgataacactaaaagcacaggcaacaaaagaaaaaatcaaaattgaaaactcttctgtatcaaaggacactgtcaacagagtgaaaaggcaacctgtggaatgggaggaagtatttgcaaatcacatatataataagggattaaaatcgagactatacacagaattcctacaactcaacaacagaaaaaataagctgatttaaaaatgggcaaagaactggaataggcatttctccaaagaagagatacaaatgactggtaagcacatgaaaaaatactcaacatcactaatcatgagggaaatgcaaattaaaaccacaatgaaagaccaccccactccctttaggatggctgtaattcaaaacagaaaacacaacaaaaacagaaagtaacaagtgttggcaaggatgtggagaaactggaacgcttaggtactgctaggagaaatgtatgacgaagtagcctttggaaaacagcatggtagttcctccaaaaattaaacgtcaggttaccgtatggtctagcaattccacttctggatatatacccaaaagagctgaaagcagagagttgaacagatgtttgtatgcctgtttatagcagcactattcatgctaattagaaggtgagaacaatccaagtgttcatggacacatcagtggataaactcaatagagtccacccacacagtggaatacgattcattcttgaaaaggaaggacattctgacacatgctgtatcaatgaaccttggggatgttatggtaagtgaattaaggcagtcagcagaagacaaatactttgtgattccacttccatgagttatctagaatcaagttcacagagacagaaagtaggatggtgggtgccaggggctggggaggaggaagtggggagtgagtgtttaatggggtgcagagtttcagtttgggaaaataaaagtgttttgggccgggcacggtggctcacgcctgtaatcccagcactttgggaggccgaggcaggcggatcacaaggtcaggagatcgagaacatcctggctaacacggtgaaaccccatctgtactaaaaatagaaaaaaaaaattagccaggcatggtggcaggtgcctatagtcccagctactcgggaggctgaggcaggagaaacacgtgaacccgtgaggtggaggttgcaatgaccctagatcacgccacagcactccagcctgtgtgacagagcaagactccatctcaaaaaaaaaaaaaaattttggagatgtatagtggtgatggctacatcacagcttgagcgtccttaacgccaatgaactgttcacttagaaatggttaaggtggtattttatgttttgtgtatttaaccccaatggggggaaaaaaagaagtataccaaagtacaaagaggaaaggccactttaatcaagggtactgggaagcctgcctggaggaggcgctgtgtcctctgggccctgctggatgggtgggatttcaggaggcagcagtaggggtggggacgagttaggaatggagagagctgttacaggtggggacactcaggtccgaggagggcagaggggaatgtttcagagaatgccacacggtcaggtgtagccgaagctcaggaatgttggaactcggagaggctgtgaaagagaagccctggctgcctggccatgatcatcatgtgcctggtcttgactggcatgtcaagaatactgtccgtgcagtggcgtgtgccccaggagcacggcagttctcaacaagactgcaccgagatctggagatgaaacttctcagctctcttacatttggccatgcggaggtctacccaggaaggacagccttgtcccaaggacctcactctgttcactcaacaggtatttatgaggcccctatgacatgtcaggcattgttctaggccctgggaatgtgggcagaacagggcagatgaaaatgcctgtgctcatggtcatgcgttccagtgggggagagacagacatgaacaaaaccagcacaagtcattcttcagatggagctgagaaccacggggaagaccaaaggccatgcggcagaaccacccagcctgcagaggcgggatcatcagggcagtgtcctcaccgctcttcttaaacactgggcttaacaggaggcttttgtggacattaaaaacaaaatcgcaggtccgtttggatccctccattccaaggtttaaacacaatggtgttcgctggacggatctaagaatcttagccactctgcctagcagcctctcaatgttttgtgtctctcgtttcaactttgaaaagagctttgtgccagggagctcctgcagtttgggtcgaggaggaccaaggcttcaaaggcccctgcccgcgcgtcctgcaggttcccattgtccgtgttaatagcctcagatgggcatcagttgccctgatgggcttgggctccacgcccgggcttgcatgtttggcaaaattactcaagagcatttcttttttttttctttgagacagagtctcactctgtcgcccagactggagtgcagtgacgtaatctcggctcactgcaacctccgcctcccatgttcaagcagttctcctgtctcagccttctgagtaactgggattacaggcacctaccaccacgcccggctaattttgtatatttagtagaaacgggatttcaccatgttgcccacactggtcttgaactcctgacctcaggcgatccacctgccttgacctcccaaagtgctgggattacaggcataagctaccgcacctggcttccaggccatttcttatcacagctaaaagtgatctgttacgtggctggttacattctcagcaactttagaattctattcagaagtggacctaatcttgagacaaataccctcttaccccttggtccactgaaaagacttatgatcccagtctttctattggtgatggttcttctattcagtgggagattatgcatttatgtgtttggatagaaattagatcctcagcctggcacggtggctcatgcctgtaatcccagcactttgggaggccgaggcgggaggatcacaaggtcaggagatcgtgactaacctggcgaacacggtgaaaccctgtctctactaaaaatacaaaaacaaaattagccgggcgtggtggcaggcaccagtagtcccagctacttgggaggctgaggcaggagaatggcgtgaacctgggaggcggagcttgcagtgagccaagatcgcgacactgcactccagcctgggcgacagagtgagactccgtctcaaaaaaaaaaaaaaagagatcctcagctgttgtttcttgaatcagatatttggatcactctagcatccaatcatgcagctcctaaatatgctcctaaatcatgcaggtccaatcacgcacctgttttacggtttatcaatttgtgctcatcctgaactaaataaacaaatccatgagccaactgcagcactgtcttttatcaccttcgtttttctctgcccagtaaaaagctgaagaagatacattctttgttaccttccattcatttccaaatgtgtaacttttcaaatatgttataaatgagaagaaaagaaactgctggattgtcaaactgtcattttatttatcgtctctcgtcagtagaaaagtccagaagcagtgcgttgagatgaaaatgaaggtgcgtgaaagagagaattggaaatgggatatacgaccgtatttcctctctttccctttccctccctcctgctgggcaggaaacgagaagaacctagtcagcggggaatacctgtctccagggaattttttgggattagatcttttggggttgggtttgtgagggggcctgccctgtccccacacatgtgattcctctcactgcacaatcctgatgcctttggcattcgtgattgccttctggatgatgaactataaaggaggcagctcttaaaagaatagaaaatgtcttccagacacaacaaaatatacactcagaaatgtataaaccagcttcccacgtccaggggctgggccagtacagattaagaaggtgaacgtgtggaaggtaaagggtgggaggaattttctatttcgtgaacttgtttttttcttgttagaaaggaaatcacagtgtatttcagtttccacaataaagtgcatctcagaattgcccaggttctgccacaagagacttacctcttggtgggctggggatgacctggatctccctgctgcctgcacgtctttcactttggacattttaagaaaaaaataataatgtatctgggttcttggagatatatacatatatatgtgtatgtatatctgagtctctttaaaaataggtatcccgggagcagagccacagcctgagctatccagatgcctgctccccttggtggaaagagatccgacacacctgttgctctgagatgcttttgcagacaggaaagctcttaattcctttgctaggccattttaacaatgcagagaaaggtgacagtcttcacgtagtcccaaaggcaattaataagcaaaaaacttacctgattttaagtgaagtgtcacggagctgtcttcacccagcccatgaaaaaccaccagtgcaccttgagacgcgtaggcaatgttcaaggccaggaaagactcaccagttcctgtgcttcccattgtcagaaagcaggtggaggatggccggagccaccctggctgcagaaactgacctacagaacttctcattgtcagaaagcaggtggaggatggccggagccaccctggctgcagaaactgacctacagaacttctcattgtcagaaagcaggtggaggatggccggagccaccctggctgcagaaactgacctacagaactgaacagaatagtgattcaagttggatatttagaatatctaaacgtgctttgcgggacagtgaaaccctgcttggtggaggtcaggacttctgcttctgtatagctctgcattccttagccaccgtcctgcaaggcaaacgcgaaaacgcatcttaaaactcgagcagaagtagccttggttgtatgcctgaaaatgcctgttcgtttggaaaaagacaatagcttcccgttttatggcatcttcttcttccttcccagccctggccatcgttctcactgtcctcagcggactccctgggcctcctctttaaaggtcagtgctgaccgggtgtggtggctcacgcctgtaatcccagcactttgggaggctgaggcactttgggagaccagcctgggcaacacgatgaaaccccgtctactaaaaatacaaaaaatagccgggtgtcgtggcaggcgcctgtaatcccagctactccggaggctgaggcagaagaatcacttgaacctgggaggtggaggttgcagtgagccgagatcatgccgctgcactccagcctgggtgacaaaaataataataataatagtaaattaattaaaaaaataaaggtcagtgctccctggcttctctgcaggccatctcctgtgctcactcctcacactctcatggagtggcctcttgatctcctactttcaatcaccgcccatgtaccccctgaacctgcgcacctgggtaccccgcaggcacgtcttaggaagcttgggcagcttctgcagaacgccttcccttctccctcctgacccaccagcactgccactcccagacccccgtctgtctcctgagctttctcccttataagctgcccagccacccaccaagcagctcaagcgagaaacctggagagaagcaaggggtcttaggtgcctctgtccctctctcctctccctttgtccccttctgtcatactcacccccgtctttcttcctcctcttagcaacacccttgacccattggactttgcagccttttcccaaaccgtgtggtaggctttggttgtggctccctgaccgtgctcccacccgctctagacagtgtgcaagcctggccatggctttcctccttgacgcccttggctgcctctccattccctgatggatcaagtccacactcctgagtgtggcgctcctgcctcctccgtggccagctgtggccacgcccatgcccccccactgcccctcaaccaccaagaactgcttcctttttcccaaatgggccaaacgggttccctccttttctcctattcctgaaatgcctttccttccattgtctgactgggggatgcctatccatcttccctgctcaaacctttcccaatttctcctggaagaactgacctcaacgccacacccacactccacggcctgccatctcccttctctttggctttcgtagctccgccacaatgtgcttgctctgttcatgtggctgccatcctccaccaaactcgaacctctttgacgaagtggacgttaggcagttcaactttgtatccccagcacctgccaccatgctcctgaaataagaggcagttgttacagttgcagtcatcctgtagcaatcgtgatctgctggtgataaccagccgtggtatatttggacaagacttcattctttttttttttttttttttgagacacagtcttgctctgtcgcccaagctggagtgcagtggcgtgatcttggctcacctcaagctccgcctcccaggttcatgccattctcctgcctcagcctcccgtagctgggactacaggcgcccgccaccatgcccagctaattttttgtatttttagtggagacggggtttcaccgtgttagctaggatggtctcgatctcctgacctcatgatccgcccacccaagcctcccaaagtgctgggattacaggcgtgagccactgcacccggccaagacttcagtcttctctcagcaagtgcttatagtcagactgttgtcatttaggcactttgctgggtacagagataaataagacatgcgtccctccttatttcacatggaccagcccaccagcaggtaatgactctgcagagacggggcagtgtcagaggagcaggggtccccaaggcagcagcttgagagggatcccttcatcttctctccagataaccagttggcaaaattctaaagcatttttctaactgttatcttatctggacaacacgatcaaaaaatactatgataggatgttggaaaaagatttaaaagaagccaaagaacatattgctcaacattgagcttttaaaatagggtctttttccgtgtgtgtgtgtgttttaaaaaaatgttttctcttgtttctacaagttttagaccaattatttttggagcaggaagatactgagttttcagatggtcctgtagacccccttacctgctggttttttggtggaatcctgtttctacaaaaagaaaaccccatagatgtagacacactaaaaaggaaaaccctggagattgtttttaatcttagaatttgtggcacttgtactacggtttttctcgtaacaaagccgcttctcgttggaaatgtctatttatgtggttcatgttgcccatgtccacttggaggttatgcctgagtctcatggctcagggagaatatgactcagcatcttttggttgagggcagctttgacctcattgttttctggtgtggcacagggagcagcctggccacgtgcggggaacggcccatggcctgtccctgttcgagctggctgctgcgaaagtttcaagaggcgtattcgccaggagcactcggctgtgaatccagacacggaagacagtggttttaatagagtaaaccaaaatgtaggatttgctctctccgatattctggaaaatcccactgctttagggcatagacttttcctgaaaatagaaggctgtgttttttaatgaggtgctgagatctttgtaacaaaagtgggggagcaactgtgctcagagccctgagggcaggatgttccctctgagctgtggccggacttcccgccttcccaccaggctcaaggttcagcagccaccttggcctctgcctccccgtcccctcccttctttccccttctccccccacttcctcctcctccgtcctccccatttgtgcttcagggtcttgcatattctggtctccctgcctggaaagctgtgtgcccagctgcctacagggctgcttcctttcctctcctccttcagagcggagtccatttcccccaccccacccctgcctcctggttgtgttcctagcgcggaggctccctgaccagctcttgctcattcgaccgctccccaacccggcgcacggtgcggggctgccgtggaaggggcgttttccattcatccgactttatttgcagtgactccacagcttagcagttcgggttaactttgaactttattttttttctgtttcagagacttgatattctttaaatgtactttttaattaaatgcgacctagacagcttctccctcctcagcctcttctatgagtaaagaggttcatgtgggggaaattgactaggattaggcttcatttccctctgctgcgtgttctttattcctgtaactacaaagaggcgtcatctgaagtgtttgcctttctgcctctgaagctacctggcgcccgttggttgctgacttctgcagaaatcctcctttgactcagtgtcttcacctccagccacctaaaaccagcctgggaaacgttcagttgagaacactactgtaaagtctcaattaaggaagtgcttgagggaaggagtgttctagttaatttttgcttaacagagcacaaccagtgtttttgttaggaggaggcagcattatgtaaaagaaagattatcaactttggatgaagacattccatgatttaaagcttttctctatcacttgaaaccatgtgacttagggcctcaattttctcatctgtaaaagagggataacaatcgttatcttactgggttgtcactatattaaatgggcaacatgtgtaaatcatttaccaagatgttttgtggctgcatggcagcttggcaaaatagaattcctttctctacttttgttttcgttcttggaactgaggccttattcgttggtatatggcattttaaaaatgttttgttaatgtaggacgttgaagtagaaggtaatagtagcggtggctcttaattttagaatctttatgataaattaatcattgagtatttgatgagtgtttattatatctcagatatgcaaataatagaaataaagaggttgtttcattcttttaaaaatgcttagatattctttgcatcttctaaaaattgaacttggaaaaccttttggtagaaaagccatcatggcaggtaaaaaatgtcgaagtccatctgttgacctcttcttgcttacaaaaggagcaaaaaacccactcaaaagcagtaaaagaggaagagacgtaggtccacaatgacaaaaagaaagggagaggagccagtaccgatgaaggatgagaacaaacacccagaaagcaaatctcagagggaggcatcacaaccacctggggagagggcctgagcctgaggacacttggggcagacttggtcatggaggggctggttatgacagagagctattagctactagcatggagggggagccattgctagtttgtataaagaacagtctatgttgtaatcccagctactcaggaggctgaggcaggagaatcacttgagcttcggaggcagagtttgcagtgagctgagattgtgccactgcactccagcctgggtgacaaagtgagactctgtctcaaaaacaaacaacaaaaacagtctacttgtaacccctcaaactgtaagcagaatacttaagctagattaaaaaggtagatgaacagacaaacagaaagttatagataatgaacagccccagagaaaagacatccacactctgggatttagcgtcccttcggaataatagtgagtgtttcactttattaaagtgaagtcgtcagttgacatctcctggttcattcatatgtataaaaggacacagggatcatttgaagaaagcccttcctgtaaaaggtatatcaaattaacaaagagggagaaaaaagatcccagaggaacacaaaacagaacttcagaaagtatttatactctccgagacatttagaaatgtatttcacccatgaaacaagaacaggatgcaatgaaaaatgaacagaggacaaaaagttagtcttgggagtcacaatatggttactgaaaataaacatccaaaagaccagttagaagataaagttgagggccgggcttggtggctcacgcctgtaatcccagcacttcgggaggccaaggcaggcggatcacaaacgaggtcaggagatcgagaccatcctggctaacatggtgaaaccctgtctctactaaaaatacaaaaaataagccaggcgtgatggcaggagcccgtaatcccagctacccaggaggctgaggcaggagaatggtgtgaacctggggagcggagcttgcagtgacctgagatcgtgccactgcactccagcctgggcaacagagcaagactctgtctgtaaaaaaaaaaaaaaaaaaaaaaaaaaaaaaaaaagataaagtttgaggtgctctttccaaaattaaaaaaaggaaaatattggaaaaaagtaagaagcatgttgaatcaatccagagtcctaaaatccaaccaataagagccctagaaagaaaaacacagaaaacagaggggagaaaattatgaaggaactaacgctatcaggtatgcatgtctagagtgaaaggacctttcagttacctagcacaatgtataaacccccctacacttagacacgttttattttatttatttttttgagacagggtcttgctctgttgcccaggctggagtgcagtggtgtgatcatagctcactgcagcctcaacctcctgggctcaagtgatcctcctgcctcagcctcccaagtagatgggaccacaggcacagaccactaaacctggctaataaaaaaattatttttgtagacatggggtttcactatgttgcccaggctggtctcaaactcctgaattgaagtgatcctcccacctcagcgtcctgagtagctgggactacatgtgtgtgccaccacacctgctaattttttttttttcttggatagagacagggttttgccatattgcctaggctcatctcaaactcttgggctcaagagagccactcaccttggcctcccaaagttctgggattacagatgtaagccactaagcctggccaaaaatcattttttacctcattcaagaactttgaagacttactttttttaagttatttaaggatactctagctaagtgaggacatatgccaagaataaggagacagtgaggtccagggaacggcaggtgttacccaagaatgcagcggaggagagtctcagagtgacgagtccacaccaaacaggaaagggaatgtctctgtgtttaaagggagctgggtagattgccttcatgtgggtaaaagagaacagtacaaaaggctataaacagaatgcagccatttttgccactcacaccagaggcgtgcttttctctatttagccctttgtgctaatatttaactccgtgtcttaacaatatgtgtctattgctagttcttgatttgccaattttagacgttacctattgaccttctgctgtgatggatgagctttttacctcatgcctcttcacacatccttctcaaaatatagtccaaacagtatgtgtaggccttttgttatttaccattgtaactctaagatatatacatgagcatgcatgcatgcacacacacacacacgcttctttatttcttgtaaactggaaacagtagcttttcactccctgttgtgtaatgagaagccaccctcacccccaattctcttctgctcttccacctcactccgtcttctgcagtttcatatcgtccaggttaaaaacatttaaattctgtttcctaggcacaattacatctggcattttagactatggattaattctaaagttgaaataaatatacactgtttatatttactatgtaaagattatctactgcacagctagacagtatagagagattatatttctttcttctacagatttttttcaccgggatttctaattgcctttccttttaaaaagaagtatttgcttgtgtgtgtgtgtgtgtgtgtgtgtgtgtgtgtgtgtgtatttttttgtaaacatggggtttcactatgtatatcttttaaaaatacatatatatctatatgtgtatctatatctgttgcttaaaaatatctgtatctatatatctttttaaaatatacacatatatatttatatatatttaaattacacaggtaaataacagaagaagtaaaaatcctgtttgaaagtatcatgaagtggtgtgagctaaaagctcatctgttgtagcagaaagtcaatagataatgtctaaaattggctaaaaacaagacatagcaatagatgcctataatttaaagacatggagctcaaaactaagataaaacactaacagatttaggggagattgccttagggagagggggtatggttttgtttcattttaagcctctctgtaatgttctttttaatttatgtgcacatatgaatttgattgaaatttaaaacaattttttaaaggaagaaaatataccaggatcatgtactacaatgagcactatccttgctattgaaatatctggattcaggtcacgtaatattctactgaaatgtttttgtgcagtctcaacagaaaatgcatagctttgccatcagaagacctatataaccttgaccttgttgtggtggtttccataagtcagattcaccttgcaggtgaccttgtgtgtgtatcaccattgcttttttttttttttttttttttttgagacggagtctcgctctgtcacccaggctggactgcagtgatgccatctcggctcactgcaacctccacctctcgggttccagcgattctcctgcctcagtctcccgagtagctgggactacaagcatgtgccaccacacccagctaatttgtttttttgtatttttagtagagatggggtttcaccgtgttagccaggatggtctcgatctcctgacctcgtgatccacccgtctcggcctcccaaagtgctgggatgacaggcgtgagccaccgcgcccggccaccactgttcttttaaggctgtaggtgaatcaacacgaaggagggcttcctcctcctgtggtggagctgaaccccgtgatggatggatgtgtgcggtgcctgcggcacttggccctgcggggctgcgaactcagccttggggctcatctgtccacagcacagccccttggagtctgccaggagctgagcccccaccagtctggggaggagggactcagtggcccaaggaccattctcctcaggcgtcctccccagtcctgaactcaggcttcctcatctgccaccgtggctgagcagtgattaatgccaaattagcaccctgttcaatgacctttcagcattagccactgcctcccttcacttcacataactatttgcaaatattagcttctccggccgtttctcctcatcagccactttcacagatgacaggcaggccgttagtctgattggcattccattcctgtcctttgccccatcgtgagtgcatccggactctgccatcttctcagaaatctgataaccagcccaggaatgttggcaattttacaaagcgaaggcgtcagcaggaaggtttccggagaagcttcgagggtccgctgcagagttggagagtctagagatggggaaggctgcctcagccccccagggacccagggctgggtgagagtcaccctcacattattcaatcaacatatagattttaaaacattcattacttggctctgtctgcatcaggcttctgtttttcttttagaattcacatgcacgtttaatacaaaaatctcatactgcttaggcagtgcaaggcagagcacagagctgtgggaaatcagagctgatgagaagcccgtcgtctctttcccgttgttctctctccgcggccctcaccccaccgccagccgggcaggctagaacctttcagttgccagaatcctccgctgccgctcacgatggtggcgagtcccttcagcgtgaagcccagatgaagcgttttgcgtttgcagtcatttccatttatttttatttccagcctcttacatctccgccctttattgaaatccctgttctagaaatgttggattggtcttcattttctctaaataaacagtagtaaagtgtactgtgggtagtttaattttgatgttaaatgtattttagagaaaagcggcaaaaaatatgtcctatttttttctcccttgtcaccagaagtacgagataaattatttatagtttgatactcaaaaaacatagattcaggatatttacttttcagaaaggaaaaaaggattgaaactgcagtaacagaactgaaccctttgttaattgaatatattggctccagggaagcatatttggacaggagtaagaatgcccactgctttccagtgacacccatgcctaacgtagtggctgatacatgaaatatttgtggaattgaacagatttggaaatagcaggtagactaggtaactcagtaagcaaactcttaaatcaataaaagaaaaataaagccagcaagcattttggaaaatgccaaacagtttaaataaagcccctcagccacacaacacacagagcagtagcgtaaggcccggtaaccatgcccggtaggacaggctgtggattgtgcctgaggacactggctgtgcttggaccccatctcatgtggtctgagaaaggccagggacagtgaccctgccccagggcttctcatgggagttcaggtaggggccatgaaatttgggtttcctattagcgtgactctgacaatagtcttcatttgtcatgctccgatcatcccatcttctatctgccctttcactttctgtggtttccattaccctccgtcaaccatggtccgaaaataggagagtacagcacagtaagatattttgagagatagagagggaccacattcgcataactttcattacattatgttatcattgttctgtttcattattagttgtagtcagtctcttagtgtgcctgatttacacatttatgacaggtgtgtatgcagagggagaaagtttgaacagatgcccttccactcacaatggggttatgttccaataaacccaccggaagttgaaaatatcggaagtcaaaacgcgcttttgtagccccgttgtaagttgaggactggactgaatgtgtatggcttttgcaccatcataaagttgaaaagccctgcgtggagccatcatacatcagggacaatttgtgtctgtagggattggtactctctttggttttaggtatccccgggggtcttggaacgtgtcccctcagataacggcggggggtgctcctgtacttagagtttcatggacatttctcttttctctgccacaggagatgttggcacacctgaaaccatggccccaaccattgtggttcccccgggcaacagaagtgtggtggctggatccagtgagaccaccttggaatgtatagccagtgccaggtacgaggcgcgtctcctgtgagactcctagtaaatattccatgacctgtgacgagccgacgatagaaggatacactggagcatgaggttcagccttctagcgacagtggtcttgtttggccgggtgggccatgaatacgagatatgggtagataaggaaatggacacactgatgtcttccagagtcccccactgcaacagggcggtgctttcaatgcagctctgggtggtagtggggggctcctctgagatcctctctagggaagagagaggagttgaggcagaggaaaaagttcattgctcttctcctcttagtcagccaaggtgttctctgcctacttagcggtcgctccagaatcaagctcggatgatcccgccttccatgtcgttgtgtcccctcacagtatttattttaaacattcatttcctgagcaaatgggatcattagcacttatggtccattgctgcggcaattagatatccttgcttaatagcccttgagcagaatgcatcgtcaatgcgtgctgggagggagtagagttacatctagattgagttttcagtgtccgttgttcaacccaccatgcaccctggtagcattagcttcgtcaagcctgtgccgagtgcctgagatgatgaccgttgccacctccctgagtcacaatcgtcgtcatgaatgcctttcattcccacaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatccaaagtgttgatgttctcaatccttccaagaaacgtccttctgaatactccagtcacaaagctcgggaaatagagcggtgaaacccctgtcatatagatccctctcctattctagctttaggctgctaagcttttctgtaactcttatttggctatcgtgatcggtgttcagaaactattctattattgctgtccaggcatggtggcttatgcctgtaatcccagcactttgggaggccaaggtgggcggatcacttgaggccaggagttcgagaccagcctggccaacatggtgaaatcccgcccgtctctactaaaaatacaaacatcagctgggcgcagtggcgggcgcctatgatcccagccactcgggaggcggaggcacgagaatcacttgaacccaggaggcagaggttgcagtgagccaagatcgcatcattgcaacccaatctgggccacaggagcaaaactccaactcaaaaaaaaaattattaatttagaaattattctattaattattaatttagctgttattttttgacctagcagaaaatgtaaaactatcggatgttaccttttgttaaacttaaaaaaaaaaagagaacagagatgcttcctcaaactgggcgacatattattcctgaaccaaggagaaagaacataaaattaagtacactggagttgcccagctctaaatgctggaaactattagtgtttagggagtgtgcattgtacagtggctaagaaaatacaaaacctattatcagtttatgaggaggttaagttgtgaggcaagtgactttatttctctcatttttccagctactgtcatgcatttattcttcataagtggccgtgatgactatgagagcagcctgtgttccgcagtggtagccgctgttgataagaggtagccttagaggccgcctctaggaaggagaatctcgacttcctctctcctctttgggaaaaaggggaattgagaacaggaaaattcaaataagaaaaccctcagagagccccttaaataaaaaaatttgcagtctgccactttgcaaaataaggaaaaaaaaaaaaaagcttgtgttttcctatgaaactagcaagaaaaggaatactgcacaaaaggtggtttaccttgatcacgtcccattcctttaatcattaggaaatgactccatgtcctgaccttgactcttctaaatacaatgcagtgcaaacctgtcggtccctctgaaagaagcgaaagtctgttaaaagcatccaaggaagccggctttgagtcaccaatcactgttgattctacatgagaggcctgagctggtattgctaccttccccatccatgcttccgctacagatgtaaatatcacatcccattctctgcaaagattttttcatcgaggttgatctgtagttctaggagcacagcacattatagattcagccaaaattaaaatttgcgacgtgtaaatctctagtagacaggactataccgtgttcaaacattttaaggtaatttaaacaagagaagaaatttatctccctttaaacgagaatgtttgtttcgatcatcattcctttttaaaatatttaaatctatcttaagagctttagttttacatttatatctgattagttttgtgttctctcgagttagcacctctccgtgttctgacttttaaaggtacacaaacacacttcacttctttatgatgttgagttaaatccccttttattcataagaatttgctgtagcaggtaggatttttgtggttggcgcacactgcaaaaaccctgaagagagtgtctgtgtcaattccgagggatttggatgagattataatcccacgccctgtggccgagcattattggtttcacagggctgtcaccatgtacctgtcaaaagggccacccgtaggagcacacaggccaaagacagagaaacaaatgggctcctattacttgtattttatactgatgacacaggacaggctagttgggctgtttgcccacctgcctgtctatgttgcttaatttctgtggcttgaatgagagcacagaggtcggcttccaggcaccaccccgccactggctgcccagtcctgtggagcagcccctctacgccctccaccctcccctcctgcctcccctctacaccctcctctcccgcatcacctctacactctacagcctcccctcctgcctcccctctacaccctcccctcccctcctgcctcccctctacaccctcccctcccctcctgcctcccctctacaccctcccctcctgcctcccctctacaccctccaccctcccctcctgcctcccctctacaccctcccctcccctcctgcctcccctctacgccctccaccctcccccctcccctcctgcttctcctctacaccctcctctcccctcccacctcccctttacaacctcccctcaacaccctcccttcccgcctcccctctatactctccgccctccgttcccacctcccctctacaccttcccctctggcctcccctctacaccctccgcttccgtcccacctcccttctacaccctctacactgcaccattcatgggcttgaatgagtgttggcctcagtttccacatccataaaatggagatggatgtagatggtaccagctcatattgtgaaggttaaatgcaaaaatgtctgtcacagaggctctgaaatagtggctttagttgctgttggcataactctattatcctatatgtcccattgcactcgctatttaccaataatcagttatgtgacacacatttttcatgtttagtgtctctggaatcaggatgtgcctcaccacctatgaaaccattttttttttccttggggtaagacaaggatgccccttacctctgactgcagcaccttagtgcctgtgagatgcatcttccctccgagccacgccttctccacggtctcctcatcacacacgaagccagctgctcccacatgtgccctgctcctgctgagcacgatggctcggaaactcggacggcgagttttcactgggatggactctttacctggtggggcatctgctgccagccccttcaagttgttcatggaattcagtgcttgtggcttgggggctggctcctggccaggggtcccctcaggttccagagtcccctgcatccctggctcatctccagagccagcagctgcggctgagttcttgtcacacatggaagctctctgctgtcccctgtgcctccagctgcagaaagtcctctccttttaggggctcacatgattaaattgggcccacccagcgaatccaagagagtctccctattttaaggtgggatacctaatcccacctgcagagtccctcttgccaagtgagacagcatattcatagattccagaggtgtgggtgtggacacctccgggagccgttctgtccacctcggtggactagcgtgcagtgcaggccagccgagggcatgcgtgggacatgctgctccctgagaggggcgacctggaaggaacagggaggcagcgcaggaaacatctttggatcttgcagtgatccctacacagaagaagctttgcaactcagaagccaaatcccagcagcattggggatgggagagcaggaaaaatgcatggtgttgttggggggtccttctccactgcggttgcctccattgggcctgagcctgcactttgtcacactggcattttggagagtgaggtcatttgacagaggcccttggtttgggggcagtctgggaggtctccccacctcctctcctgagactggggagctagaagcttgcgctgcccctggaggcagctgccatgggctctgggccatgtggaaggcggaaaatctgagctggccttttcctaacaccctgacttcacacagggcatgagaacctttccctgatgtcttcatattgtttcaaaagagggagaagtgtttgtttccatcccctgttttgttggctgcagtcaggatcaattttcagaagtccagggtggacccatgttggcagagtaccctttctagacacagttgccactgacaggctaagacatgccctcgccctcttgccctctgaagagtaagtggttgagagtctatgcacaggatgactcatttacaatgggttttccccagtgtttaactcacgggcttttcacggtccataggcttggcatttcctccggttctttgccttagagcagactgtgtgtaaaaccgtagctggaaatggggagaaactccatctgagcagccgctgggttagaatactaggaagggttggcagggagagaactcgtaccctcacacggtggggaagtactaagggaagctcagaggccacgcagggcatgggcagctctgcacctgctccccaggcacagcgacctggaaggctttccagaacaagctaagagcatccacaatgaacagccagatgttttccacccatgcctagcactgagctactaaaactgcccaggacattggcccctgcaggcggtggcaggctgccccccagaccttgcccatgccacagtactatggagagtgtggagtgggatgagttttctcaccaggtggcatgctgtgtgccaaacacagatggtccctggctagggtggagagaggtcaccacttggagaggagcagcatcgtctgggcctggaggtccccagagccatgcacttgctcagccaagccagcttcgggtcactgtgtggagtgcccgtctccctgaccccagcgaggtcccttcctggcactcgagggaagcctcgggggactgtaccaggcgacaacggtaatcagtacctcagggaaggcaccctgggcccgtaggtgccgaccattgttatctatggattttgtatcatcaaagcacaggtcatcttgggtgaatctcaagggaaccatgaagagtgaaaaaaatagttgcaaaagttacactcgatgacctcctttctgtaacgttcttgaaatgacaaacctacagaaacagagaacggattagtggttgtgaggggtgggggtttggggtgctcctggtcatggaaggcaacacccttgtgctgatggacacgtggacctacacacgtaataatgttgcatgggacgtgcatgtgccgtcttttcacgcacacttgagcgcaggaaacactggcaagagctggataaattaggttgattgtatcagtagcagtatcctgatcatgatgttatgctatcgttttttgcaagatgttaccattgcgggaagccgagtgaagggtccatgagctctttcagtgttacagtgttacttctcacaactgcacggactcgacagttttctaaaaagaaaacgctcaactaagaagaggaaaactataattaatcataagcaaatgttgttgtcgaatgtatgtttttttcctttttccttccatgcttttaatcagatcatgacggtagatattgacttagcttccctgatgaatacaggtcaggacctgcacacaagggccctgacagcaggcagctactgtatgtatagttggaatataaataatactgccttcatgattattgattgaggaaacgtgatcaaatgggggatgtatgagttgtgcaatgaagatgagcttgaaaaaggtagacattaaatgctggcaatatttcttcaggcttggtctgtacacatgaaaacttaagtagaggaatctgcttccttctaatgaatttgcagccatctcctcagccggagtggttgattcaggcagattctttctgcttgagtggtccaggtaatcgcagaagtgaaacatcactttgcctccttccagaaaccttcagccgcttcccccttaatcgtttctttgaaatgcttagttttcatttctctttttcatcttttaggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgcaattggctctccaaggaaattcattgtttaatacaaccactgtttttttttctgcggaacgggcgagtggagtatcgagagattgcaagtgcctaggagtttcctttgctactaaagatagatgagtgctcccttatatgttttctcttagttattatttggtattccattgaagtattaaatctctattttggagaagaactgctaagaattttaaaaatatgttaataggctgttgcccaatacaggctgcacaccttcctcgggcacttgacaagcttcacgagctcgtgtttagtttagatactgaagcaaactagcccataaaatacggtgctgtaaatataaacctttacgaacctcttggggtagtccttctaaaatgtaaattaagatattccatgattcaagcccataaactgaaaagtagccatcaccctgagtagtaagttgctttctgaaaccccagactgtaaattgcctttggcctgtgctcactgagttctgagtttgtatgcacgatgctaactaatgatgaaattttcaagaatggtttttaagaggagcccacactatcttaggttatatggtctctgacatatccttctttggcttaggggcttttttttattttcttgtttgaagagccaccatattttactgctgagcccgagagtcggatttcagctgaagtagaagaaactgtggacatcggatgtcaagccatgggtgagtgcagagtggctgctggacaaggagccatgactgggaggaagggaaacaacctttttccatagcagaattgccatcattctagggagacattgagtgtgatggcgaagagcagacttcagagagtagatcggtcttggggcagtgactgtgggtaaggcatttgactttgccaagcttttgcttcctcccctgcgaaacagagatgatactatttacccagcagagcaaaaaggaagcccacatctaccccagacagagaggggactccatcatatcctgtggactccccttccaaggccctgacttcacaagtgtgtgaccccccgagattcggggcagaaaattctttctcatccatggggtgactaggactggtgagcacagccactctagaaagggagatgggtgtacatgtatttgtagtaggtacgtgaggtacaaggcaattttgttccactgatgtattgcacagtggtgaagccaaagctgggagtgcgtccgtcactggagtgatgtaccctgtacccgttaagtaatttctcatcgcccaccccacacccttgtgagtccccattgtctgtccttccacactctgcatccatgtgcacatgtgacttagcacccacttattagtgagaacaggcagtctttgtctttctgtgtctgagttctctcacataactcagtggcctccggtgccatccaggttgctgcaaaagacacccttttattcttttttgtggccgaatagtatttgaataggaaatgttacctttttttttttgccttttcagctctgggtccccttttcctttgccattcaggtcatcccagccctcatccccatgcttcaattacaagctgcccactgtcaccgtctcatgtcgggcagcacaggtgattacacaaaaccttctagcagagacaggcttgtcaaggcagtttcgttaagaaaagctgtgtttgtattctggcaactatcaggaaacgaaaaggatcttttctcttttgtttatacccatccgtcctaaggatagtattttctcctactccctaagagctcggagggtaagaatgactaccagttttgcaaatcttcaaaacagctcctaaaagagagatgattttcactgtaccacaggaaaaccaagccctggaaagcatggttaagtacagtgccaaaggcactgggccactcaatgaaatgggatccttctctggtgaagtcattgcccagtgtgtggcctgtggaagttactcattaaatactgggtacctaacttacctaggtccacatggtaatggaggcaggacccaaacgcaaatctgtcagccaccaaagcagccacctggctcttgccagaacactagcttcccccaggacctgaagccctggacttagaacaaatgccatttgtccatacctgcaactgtgtggatgccatttcttattcctgaaaatggtgtgtcacccttccagtgctgtgccacccttccggtgcagcggcgtgtcacccttccagtcctggtggtagagggaaagatcagcctctgcccacagaccccctcccgacccaccgtgctttgtaaccactgctcctggcccgggacttggttcagtaggagttctggtcctcagctcctgaccagctcacagcggctgctgtccacggctctgttctgtttctgttcttctctgttccagctctactgattcggcataggggagggggaaaaagtgtgagagaagagtaagacgaattttacgtggaattatctttcttacagtggttgcattgttctttcttgtgtaggtgccagcttcttaaggccaacaactctgtgaatgtgaagctataaaatatttagcgagcttatatttcagaaataagagtatacaatactgcgggggataagatttctgttatgacattaaattgccccaaaatagaaatactcccagttccctatgtactaacaattatttttcaacaaatgacaatcttaaactccctttgacaagagaaagctctgtttttttgcacgacttctgcagggtaaactgcttgttaagtgtagacttacaaatatagagacaacagatcttccgacattgcactgctgtcatataatttactgctttcttttcattttgacagtgaaactatagcagcatgcgaagtggttattccttatgaaagtgacatcatgtaactgctattatgagatattacatgaattggttatgcttttaccttgaaatggattttttaatatttcctgacttaatgaaaagtgacaggaaacataattaaggcaaagaagagaatctaggaagacattatcttgagttattccatggcattaactttatttattaaagtcgacatctcacacctacccacacgccatcttaaatcaagggattttggtgtgctttgcactgaagcatgtcaagatatgttttttatttaaatccactttctctttagggaaactgaggtacagaaccatctgagatctagagctaagtgtagatatgcctcatggagcgaggcagcttttcctgtatccacaatggaatacctcttgtgcctcctcctcgacccttaacaaggttacttaacctaacaaattgctcctctgagacagtagaactccatgaaggcccatgatatccaacccctttgatagggggtgttaaaagatggcactcattttcattgttagctgttgggatgaatagtgatactgccattgagcactcaccaggtgccgggcatgagttttataaatacatatgtaaatgtacacacatgcacatatatgcaccacctcacacagacacacatagaaacacatgtacacatatatgcaggtgcacatatacatacacagatgtacacacacatatacacacacgcacatgtatacgcatacacacataaacacatgcacatatatgcacaaacacacacacatacacacatgtaaacacgtagacacatgcacatatatacacacatgtacacgtgcacacactcgcatgaacacatgcacatacatatacacacacatgcacagacacacaaacacatccaatcttcaaccttctgaagtcacaattatcactaacctgcatgtgaggaaacagacaaagaaagggacaggtaatgtattctgcccaaggtgacactgtccgcgaggcatggacctgggatgtggcctgtgtcctgtcctctgcccctatgaccctgtgcccaagccctcccgcggtggctgagtagggcactgcagagcagagagggcttcatctccatctgaaccttaacctgactctcagctggaatctcctttccaaacaagagcatgagcctgtgtgggttcggagtggagcctggaaggcaccgcagccagggcggccacagttcatgccagctgttcctctcaacacccctccgtgtcgatggcttcatctacaacgagaaaaatagctccttatagggtggttgaaagcacgaatacacaagaaaatgcctattaaaatattggcattctagcctttgaaacagatgtgcttcagttctcacgtcaggaattatttttaaaatcctatttattcccattcctacgcaggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccagtgagtacacccaggcccacagctacctgacctggacgtatccagtgagtacactcagccccatggctacctggatgtaaccagtgggtacacccaggctcacagctacctgacctggacgtatccagtgagtacactcagctccatggctacctggatgtaaccactgggtacacccaggctcacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagtacactcagccccatggctacctggatgtaaccactgggtacacccaggcttacagctacctgacctggacgtatccagtgagtacactcagccccatggctacctggatgtaaccagtgggtacacccaggctcacagctacctgatctggacgtatccagtgagtacattcagccccatggctacctggatgtaatcagtgggtacacccaggctcacagctacctgacctggacgtatccagtgagtacattcagccccatggctacctggatgtaaccagtgggtacacccaggctcacagctacctgacctggacgtatccagtgagtacattcagccccatggctatctggatgtaaccagtgggtacacccaggctcacagctacctgacctggacgtatccagtgagcacacccaggccgacggctacccagatgtatccagtgggtacacctaagctcacggctacccggacatatccagtgggtacacccaggctcacagctacctgacctggacgtatccagtgagcacacccaggccgacggctacccagatgtatccagtgggtacacccacgcccacggctacccggatgtatccagtgggtacaccttggcccacagctacctggatgtatccagtgggtacacctatcagcaaagccagacctgctagactgggccttcaaggtagaacttcccaaaatttgctccatgtactacacacagaaaatggtagtatctgttcagccccctgaggtaaacagaaggggtaatgtggccagaagtgggcagaccaggagagccagctctcaagcacacctgaagcctttgtgggtcctgtggggaaactgctgaggcccacaagcagcacagacggctgtcactccccggccctagtaccctcctcttctcagggtagcgttgcctcttcccgcactaagccctcctctttcttgaggagaagtagaaaaaactcccttattttctgggcagaattggaaagactattgagtgaatagatcactcctaatctttttcttttgatctttttttcctattttttacattcattctctattttacttttattgaacaattgtagttcttttgtgagtttcttttattatcccattaacagaaataccttggctctctgtctttgaaaaataaactcaaggtaaaggttttcattgtttctgtgggttttctttttaatcttccatggttgtataatactgttcttctaaaatgaagtagaatctagtgattatggaattataccttttgtgtttgccctttcgggagcaaaatgctgatatcctcaggggtgagagctgttggagagagcaaatcagtgtcactgtgtgcacagccaagggctcttcccacccacagcctgcaaggagactgaccaggtgtgtagcaagctgtgcatgtgtttcggtgaactaggggtcccttccttgaatcttgccctcgggtcaaatttgtctttcattttggagcttaggaaaccaatattgcttcaagcagtagaaataatatggaatgctcaagtcagaacatgagtcttgattgattagaattatttgaagcctatcttgcaatcgtgagctgggacgttcttgagcagggattgacaagctttttctgcgaagggcctaatggtagatatttttggctttgaaggatgtggcctactcagcattgctgtagtaacctaagagcagccacagttctcagcacatgcgagtggctgtgttccaataaaactttatttacaaacacagggtgcaggctgaatttggcccccaggttgtagtttgccaatctccattccagtgagagacttaggaatgagaataaaaaagaacccagagaacatctctgggtttctctcagcctcagttttctcatccattaaaatggagctaaccaaacccagattataggattctcatgagggtcagattggaaatgtaagtgaaagtgccacctgcactgttaccacggcagtgagtgagtgaacaaacaaatcaatgattgtgattatgttatctgttttgtagtaggaggttttttgcaaaatgagttttttaattaaaatacccttaatgaaaggaaaatgtgctttaaaaaatcgatattgatttgctcatttagcaagcggctgctgagcatctgtgtcgggcactctggatgaggctctggggacacggctgtgaggaagacaggtgaggttcctgtgcttccaggacagagggtctgcagggaggagaaaggcagtgaaggacgagatgactccagccagccaggggtgctgcagaaaaggggagcaggtgcggtggcatattgagccggggcctcccccagacagtgtggctgccgggtggggcttctctaggagagatttagaaggagcaggagtgtgaactcttggggacatgcgcattgcatgggctggaggggacatcaggtgccttggaggagcaagctcggcatgtgtgcaggtgaagggaggcggataggttggggctcagtgacaagcagggtggccatgacgggctggagggtggagggataggcaggggcagaggccgagaacaggaggagcctcgggagctgcgagcaagcagagaagggacatgaaagcctttgtagctttcaaagggcagcccaaggctggctgcctcagggaccctgacacaggcacagaagtgttgagacctgttagggggcctgcggcatctggcaagacctggactcgggtggttgcctgcgaggtggagagacaaggtcagcttcaggaagggccttggcagtgaagtttctgggacttgccatggtccatgggattctcagcaggtgcaggcagaggcggcggctgtgccctgggtcccgtgaggtctactcacttctttccttgaggggtatcagcccagggaccctcacagaagacttgagagacacagatcactgttgtacggggggttccggttaatcgttattgggtagcacagagttaggcgagccctcgctgaagccatcaggagctcctcctgtctttcctcggtctgactcagggctgctcggggccgtgaccatcccccatgaacaagaagaaacccagcacttggggatcatgacacctcccagaaatgtatctttatggaggtctttgaaacctggttattttaactctcagaacagatcctagaaagcatcctagaaagtgtcatcttgtggatgacattttgtattcaataattagcttttttttttgtttttgtttttgagataaggtctcactctgtcacccaggctgtagtacagtggcacgatcatcactcactgcagcctcagcctcctgggctcaagcgatcctcctgcctccacctcccaagtacgtgggactataggcctgcaccaccatgcctggctaatttttcatttttggtagagacagggatctcactgtgttgcccaggctggtctcaaactcctgaactcaagcagtcctcttgcctcagcctcctgaagtgctgggaatataggcatgggctacctttcatttaaagaacaaaagcagtcttttggctgatctaaataaatgcctctcctctctttaatattcatcaaaaactgttcttcctgggcccctgcacgtttccacttgtgtatctattacatcgtgacgctgtattttctctccaggttgtaaacaaagatcggtaactcctgggagaggaacagtggagggctgccgtccctcctgaacagtattccttttgtattgctacagttacctctgtgattggctctctaaagcccgtgcaggatactctgccaggctgatgtgagcctctcaggaacaaggccctgatcatttcatttactcctcttctcagatatcgctccagtgttcacccagcggccagtggacaccacagttactgacgggatgacagccattctaaggtgtgaggtgtccggggctcccaaacccgccatcacctggaaaagaggtgggtagcatccactgcccacaacagcatggcccatgtagaacataacctatcgggccagtgcttgcttcttattcactctcttgtttattcacttatgcattcactcaatgaagattaaataactcttattgcagcagtccccaacctttttggcaccagggacctgtttcttggaagagaatttctccatggtctccagtgggggctgatggtctaaggatgaaactgttccatctcagatcattagattcttctagggagtgtgcagcctagatccttggcatgcatagttcactggagggtgtgcgttcctatgagaatctaatgctgctgccgagctgacaggagggggagctcaggcagtcatgcacggtggccaccgctcacctcctgctacgcagcccagttccaaacaggtctgcagcccagggcttggggacccctgatttacagaatgcctaccaggtgcaagataccatgggcacaaggataaataggacagacaagatccctgccttctagaaagggaaacacacattagaaaaagagaaggattgtgcaaatgtcactcttctctatccacgcccttcagagagtgcctcaggcctcctcgggccttaccgtgtcaaggactggatgtgaagtcactctgctagcactcacttttcccactgttaagtggagctcttccttgtgacattcagaattaaggatcacggcctttgttttgttgaagaaagatgcttccagggccacatcgttccgtgccttctgcagtcaacctgggacgcttcagcccactgtgggttcagttcctgggaaggctgcctttgcagttcccatagcccgttccatgagggccactgaaggaacagcacacagagtccatcctgaacaagtctgtgcttagccttgttgattcacatggatgagctcctcatacttgctgggctgtatcgggctgacatgccaaaagccttatctttctcttccttctggaaaaccacctggcagcttctcgactctcagaggtacaacccctgcactcagacacagctcctaaagatctgggacactacagatcaataacagggctgggcttttattctctcttgttttcctgcctaattttgaacataatagctttatataaaaatgtttcaaatacatgcagatataaagaaaactaaaaaccgatcacccaaacatagcaatcacgttcatggatcataatttgtttaaccaaatctctaaatattgagcaagtaggatgttcttggtttttgttattctaaacagtgctagcaggtactgcttcagttatttcttttcctacaattttcactttattctgattatttccttaagttatttctttgttgtattagtccactctcacactgatataaacacatacctgagactgggcaatttacaaagaaaagaggttgaattgactcacagttctgcatagctggggaggcctcaggaaatcatggtggaaggtgaagaggaagcaggcgcatctcacaaggctgcaagagagagaaagagcaaagggggaagtgccaaacagttttaaaccatcagatctcatgagaactccctcactatcaggagaacatcacgggggaaccaccctcaggatccagtcacctcccaccagattcctcccccgacgtggggattgcaattcgagacgagacttgggtggggacacggagccgaaccatattacttgcttatggctctaaccactatcttcatttccttcaagcgttacgactgtaacatgcctcttttctccactgttctttagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggagtaaggagcagccctcgcacgtcggccttctgttagccacggtttaatcatcacgtcatcgtgtgctttggggatgtcagcatgcccttgggcttgctaatttaatcaaaagagaatgattatttttacaactaatttatagaaatctgttgagaaattaaattttcaatgtctaaaagaatacctagaaaatgtattcagagatttaataggggcattgcaggagagacgaaagattgactttgtaaagtcagtggagatattacacaaaactagctcaaatcacaaaattgataggttggttaattttataagcattttataagaaaattaagaattaaaatcctaaagaagtaatattttgctaaacatttgttagggacaactaaaacacttctaatacactaaccatcaatgtttcttgtatgttaggagtgaactgaaagaaaatcttccgcttttgctaaacaattgttaggaacaactaagacacttctaatatactaactatcaatgtttcttgtatattaggagtgaactgaaagaaaatcttcagcttttgcactttttaaaatcaagacacattttggaaatgcagagtagttttctggagcttaaggattggaccaaatggtcccccattgccactttttaacttcaattgccaatacactttctcctctctgtctcatctcaatctgtactactaaaaactcatattcaaaaagcaaaagaatgctcactcagatttttacaaatctatctacatgaggagagaaagttttaacttgcttgagggagtaatttgttgaaacgttattcttccagaaaaagtaaatcattgtgcttcatttcatatttgtctagcattttctatcatatggttggtgtccactttgataaacgactcttcctaatttgtaaaatgatcatgcgtttaaaggaaattaatccaagttcccactattctgtcaagtactaaaaagcagcttttgttccatttggtggatgactctgtcagccacttcgttcattctgtatccctaaatagtaaccatacatttaacccatttatgcctgaggttgcagttttttgaacttttgtaatcagaacttggcgatgaccttgagcagtaggatattaaaaagcttatgaaaaagtggtatctgaatctctgtagatcattcgccagaaaattttgtggatctgctgagattcaacattatagcgacactagcctgactgggataacgctttggtggctttacagaacattttcacacactctgcccactttaacctgtacaactattagtgacgtaagcattccctgccatagccaggaaaactaagatgcagaattgtttttctggactcaccattagcagaggtcaggcttgccctcgaacttagccttgtgactccgaagttctgggctctgttcctggaagcagagcaggtcccccttagaggtatgggtgctacagtgacccatcgcacaggcaagctgggggtccccatcccgtactggcttgggggaggtgggcaagtcactgcatctctgagcgtccatcttccttcctgaaaactgagaatagtaatatttagccctcacaagagtgtcttgaggaataaacacaactcaaacaaaaacacttgacagactcaaaaagtaccatgcagacgctagaaatgactagaatgatggtcatctagggagagaatctaggttttattttagagcctagaacctcatccacacctgcatggggtggtcggcattcagttacttccatggtgtttgaggttaaagctgatttaggaggggtgggtgggttgacagactgctgcaatggtttacttatttgcttgtttttaactcccctagcatttctgagagtgatccatttacactcattctgccaagatgagagaaaactcggaggttgtgatgtcagatgaccagggcattatcccccctgagggcagaaactgtcaaacttgtcatttcgtctgactcgtgacttgtgtttttttcagatcggacgtccatcgtccaccctcctgaggaccacgtggtgattaaggggaccacggccacgctgcactgtggtgccacacatgacccccgggtttcactccggtcagcacaatcagttacaatgctttggggcttgttgatattctgtgagtttctgaagtgaagttgagatgaggaggaagaattgggggaacttttgatttcagcagcaggtccctgattacggtatcttctggttgtgggcaccgtcattaatcatgcaaatcccattttccactccagccttatgtgttatttacagtgagctatgttccacttcatgacgttaatgctgcttttcatgatttttcctgccaaggttaatacactatctgtaaaacgtacttgtcagaggctgatactcaatgagagaaaaatccagggggatcgactaggattcagcattgtttacacgggggctgtgccactcccgggagagttctttactctcgggatagtttcatcgtgaaatggagggggagggagtcctgtgcatgggacaaagtcacccacagcccccagtgcactaataggaaggtgcatgccaagagggaggccagatgtgagggttctcttttttttttttttttttgagacagagccttgctctgtcacctgagctggagtacagtggcattatctcagctcactgcaagctccacctcccgggttcacaccattgtcctgcctcagcctcccgagtagctgggactacaagtgcctgccaccactcccggctatttttttgtatttttagtagagacggcgtttcaccatgttagccaggatggtctcgatgtcttgacctcgtgatccacctgtctcggcctcccaaagtgctgggattccaggagtgagctgccgtgcccggccaagggttctctaaaggaatgccgacatcctgtctttgtttaaattcgggccaggaaagtaactgcaaaatatgagactccaggtgaagttgtggtggcagacaggtgggcatcagtggggagctgttccctgaagagcagccaccttcaggataattttaaatttttggaatcagccttgaaaataaaaaaggaaatatccagtcatcagagtatttccactctggccttagcccagaaggggcacagtgcatgagtcgaatgggcagactactcaagatgccctgctgctttctggggcctctcaccccgagcagaggggacagctgtgggtgcacagtcagcagcgggacgcggagactcggctgttctctcgcgcttcttgagcgggtgtttggccaattgtaaatttccatgtcgccacccgactccctggggtttcccagggctcagaatccaaatttggtttaggtacgtgggtgccgaatgcaaaacaaaacaagcaaaacaaaaaccagcaagtgaaagacgacctaggacccccctgggggccaccctggagacggtcgtcaggcctcggaaagagctccttcctaaatgatttggagtatgacttcaaggaagtctgcttttctgctactctgacagctcagaaagaaccccctcggatccctgtggtttcgtagtagcttgttatatgtgattaaattggaggccccttcctcagatggaactgggttactcgctctcggggtgcccctcgtcccagggttgctctgccctgaggagcgccaggctgtaagtgaccagccagccagatgcgatgccccggcgtgagcagtctatccatctccctcttgtggaatcagccctgttctatctcagggtaattgctgagaaggtagtttgtaaatgtctgtgcttatgactatgaagtctttaaagaactgggcacatttgcaaaacccgatcaaattattgtggaaaagaaaaacagcactttcattccatatagcaatgagtgctggccctgcccgtggtcatctaaagactgggcaggctctcaattgattgtgtatttgaaaagaaaaatgtgctcaaattgctacagatagattaaatgagaaataaatgcaattttaaggaccatctgccagaatggtcacattttaagaaagtgtgtttttgaagggtgattttttttttcatgagttgggcaattccactctgtagattttttttaaacagtcgttgcctcctgtccagacaacactcttgtcctccaggagcatttaccggggcaggaatgttgggtgcagttttcataggtgacaggtatgcccgtggttctacagacttctcatctctaaaacacaaggtcagacaggcagggccagtcattttcattgccctgtttgtaacctcagcatgtgtttttgtattatgaccaagatttctggttgcttttcttttttttattattttttggtttaattcatatgccataaaattcactcttttaggccaagtgcggtgactcaggcctgtaatcccagcagtttgggaggccgagacgggcagatcacttgaggctaggagtttgagactagcctgggccacatggcaaaacctcatctctattaaaaatacaaaaaaattagccaagcatggtggcatacatctgtggtcccagctactcaggaggctgaggcacaagaattgcttgaacccaggaggtggaggctgcagtgggccaagatcatgccactgcactccagcctgggccacacagcaagactctgtctcaaaaaaaaaaaaaaaaagaaagaaagaaaaagaaaagaaaaatcactcttttaaagagcacagttcagtggtttttaaagtccattcacaagattgttagttgcttgctttttaagagacagggaaggagcagtgattctgtcactgtggggtttgtaactcaagaccctttgcttggcccacagctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgatgtgagtactgagacgtttggtgttagccagtccgcggttttctccgttactgtgcccctgttagtgactgccacttcacaagtgtcacgcccggcttgtgtcccaagtcagcggtcagaggccagcgcatcatgctgcataactacatatatggacaaggtttttttgtggtttctttcaacttcggaattgagaagtttcgtttttggtgtagatggtgtgatcattggtttttatttcagttgatcctttttgtcatatttttcccgtggacaccttatcctgataggccctgtttaccactctgcgcttaagtagcaagttcatttttccacataatacccttgagagcctccagtccatgagagatgctggagtgggactgctgaggcgaggtcgttcccgtgaaagccacctagacttggggtttcagtgagtcccagctgcccctccgtgggtaaatagatactttaagttaagtcttgtgaaatcttgaaaacagaaagcaactgcccgttacttccaatctggaccttcctgggggttccaaagagcccaggcgggaaaccgtcaatctcccccgtctctgctctctttctccctccactcccctctctattcatggagcaggaaaccaaaatacctgctgacacattttatttttctgacatgtatttatttgctttttaaaagttgtgccatctcaatattccgtgagtgcatgagtacaaaaataaaacctgaaaataaagaatcccaaccgagcactcatcaaggcagtggccagctccagggacacacccagcgcatccgtccctggtcatcgtttgacatgctgggcctttcgacaaaggcaatcttgagagatttttcctcactggaccctgccccctttgatccaggaaagattctgtattcaaaatcattccccacaaatagaatttgaacactccgagtataggagccgtgactcattgatccctgaatcccaagactccagctgaggggattaaaaatgaaaagaatgcttgctaagtgctaagcatgtggcttctgtgtctgccacacgcatgtggaaatgagtgaactcacaaacagctttcctgtagtccctatttgtggatataaaaggttcacgatgtgtagcagtcagtccggaaggccctgtggtgtcatcagtacctgaaaaacatcccatcccaactcctgttctgtctccttccaggatgaccccttgttctctttagatagcagaggtaattgtggttagttaggaagcggcaggagtccccatggctctacagaatcagccggcggcagtggtgcgggggtcctggtgctgcagctgcaaagctgccacgtagagggtcctccagagaatcactgagggtcccggggctgaggctgccacgcagagggtcctccagagaatcactgagggtcccggggctgaggctgccacgcagaggatcctccagagaatcactgggggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgtagagggtcctccagagaatcactgagggtcccggggctgaggctgccacgcagaggatcctccagagaatcactgggggtcccggggctgaggctgccacgcagagggtcctccagagaatcactgagggtcccggggctgaggctgccacgtagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggtcctccagagaatcactgagggtcccggggctgaggctgccacgcagagggccctccagagaatcactgagggtcccggggctgaggctgcgaggctgccacacagacggtcctccagagaatcactgggggtcccggggctgaggctgccacgcagagggtcctccagagaatcactgagggtcccggggctgaggctgccacgcagagggtcctccagagaatcactgggggtcccggggctgaggctgcgaggctgccacgcagagggtcctccagagaatcactgagggtcccggggctgaggctgcgaggctgccacacagacggtcctccagagaatcactgagggtcccggggctgaggctgccacgcagagggtcctccagagaatcactgagggtcccggggctgaggctgccacacagacggtcctccagagaatcactgggggtcccggggctgaggctgccacacagagggtcctccagcttttgtgtacgcatggggcagccaggtttcccccagcccctgccttcaggcattggagcctacgaccctgggttctttctgcccttcatgagccccagccatccactgtctctgcggttgggtgctgtcatccgtgggcttccccggaggtctcctgatcatgcaccccttagcattcaacgacagtagcacttcctgcggttcagttaccaggatgctgcctgcagttcttccctgcgcgcagctgatcctcctggtagcactgatcacgctgcagaggacgaccatatcttcatggctccctctcctcctggaacagaagcaccttggtggcactgttttgaattttgagtgcctgatgtagtatttgttgtataaccgttgttcaataaatatatgttggttggttgctgcctgcgtgcatgcatgaaggaatgaatgaatgtgtgtctgccttggtggcccattggcgggcctccttctgttccctactcgtaccttgatgctcacatgccctggtttccccaccatgggtatacaagtaagctcaggtcgttctaccaaaacccaaacagtgagtacccaaagccctcatccagccctgctcctgcctctttcctccttcctttcgggtctcagacagaggattttttttttttcattttgataatataggaggatatggccagtgagttcctaggagctgttgtattatgcacatttttaaagctacctttgagaaccttagatcatccatcgttggtatcaaataaataagcgttagcagttcataaagactctgtcagcagaagccaaattgcatacttccaatatagcccattctttttattctgcacagttttatggtctactgatttacatgtcttccctactatttgcttatttgatttcctctaagtaaaatacatttttcagcaaatgttgctgtatgtataaaataataggctttctctaacggtaaaacatctcatctctaaatatagaaatctctgcaaatttgtgattcaaactaatttaagtacaaactggttacagaactgatttggaagacagttgttcctcgtgaattgttagtgtcacgaaggctcctctatcccaaacctggatgaattgggaaaggtgttccttcatggggtgtctttagatccaacagagcttgactctacaacaataatggcaatagaatgataataataataacccgtgattgcagggcattctgtccttcttgggtaactttcaaactgagctctgtagtgtttccatcatttactcagataaccaaaaaaaaagcaagagaaaaatctcatattgccaaagggaagggactgagaggtgcttatgactaaacaatgtccttcagaggagcctgaaagcctgttttctccttgcctctccacttcagttaaaagctgcttcattaaatatagaaattacgagcatctgaagtgagcttttcaaaaatagaccagccgttggcctcttctcacgtctgtttgccccgagttttacacttagcactaagcttcacctcattgaggctgagtggaggggcggcccccacacccacatcacacccacagcagtcctgatggggctgctggacagcagtggggccaataggagcaaagggctgcacaggaggccctgctcacctttcactacttgtgtgactttggacaaatcccctcacttctcagcttctgcctctcaccttgtagactgggcatggtatcattcatctcaaaggacggctgtgagggcggcacccacccgggtttgtaagatcctgttgtggaagccagttggggagggatgctctaagtcctagctcttcgtgctttcttaccatcttatactagaatgctgttcccccctttcctaacagcaccctgcctcctggggctgggaactttctagccctttaccctgcattattctgactacattctatgaccttctgacactagactcgagatgtgtctgtttgctgttgagccctcaatgcctggaccagtgccaggtatacagtaggaacctaataaatgtctgggtaagcctcactccacctactgagctgaaatgagacggtgtcttttgccctactgaggaggaccaatttaggagggctctgccttcatccccccactgagagaagaggcttctaaactccagatggttccatgaggcagcctgtaaattaacaagacaagtcatcattaaatgctggtcaccccttgttttagtagcgtctttgctctagttttctagtgccatggggacaggagccagtttccaggatgacttcatattccccaaagcatcttcctgtattgagcacaccagagggaccaggctcctaaggccttatggattgattaattgttaaatcatttaaagacccaattagcatttcatctctcctcctgaaatcagagtctaattctcatgggcctggagtacagagaaaacccaatttacagagctgacttggagaccctgaggcattgggagaggtttctttctataaaaccagttctgacagagccctcgtaaggagtgaagaatttaatactgtttcccccagagttatcaagccctgtcatcttcatcctcagagtgaagtcaaagaagatgggtttgaccaagtcatcatttgtgcattaaagggccaatgctttttatgtagaaaaaaagtacttatctgatcctcttctgccagagcaattccccctacagccacaatttcaccaattgctttctttcgagtctttttcaaaactgtttttctcacacacaccttgcttcatctctctcccgtactgttgggtttccgttactgttgttgttaatttctgatattcctgaggtgtcctgtgcctgacggtggttttccccctattctctttcaattacaaagtgactcagcactgggcttcgcttccattgttctctgggacctcttccatttatcagcctctgtgcttatcactgtctgtgagtcactctactgatcatttatctcctttcaaagctggcagagtaatgcttcgacgcaatctatccccattagataagattttctgaaatggattcagaatatattaaagcctcatttatctgttattgatgggttagtcaaggatctcacaaagcttcattttccaaataaccaaaacttatcatttaaagaaatagtggctggccgcagaggctcacgcctgtaatcgcagcactttgggaggccgaggcaggtagatcacgaggtcaagatttcaagaccagcctggccaagatggcgaaaccctgtctctactaaaaatacaaaaattagccgggcgtggtgttgggcacctgtaatcccagctactcaggaggctgagacagagaattgctcgaactcaggaggcggaggttgcagtgagccgaattgcaccactgcactccagcctgagctacagagcgagactccatctcaaaaaaaaaaaagaaagaaaaaaagaaatagtttatatttccagaataaggcacgccatcttctattgcatgcctcaggtattgcacgtttgtttttgttatttacaaactggaggtttgcagcaaccctgtgttaagtaagtctattgatgcaatttttccaacggcacctgctcacttagtgtctctggtcacattttgggaattctcacaatgtttcaaactttgtcactatgattgtatctgtgatggcactccctgatcactgatcttgaatgttactattgtaattgttttgggacaccatgagccacgccgatgttaagatggcaaacttaagctataaatgccttgtgtgttctgactgctccaccaacaggccattccctgtctccctccgtctccttgggcccctgtattccttgagccccacagtgtgaaatttggccagttaataaccctgcaaaggcctctgagtgtccatgtgaaagagagggttgtacgtctctcactagaaagcagactggaaatgatgaagcttagtaaggaaggcatatcgaaagccaagacaagacaaaagccaggcctcttgccccagttagccaagctgtgaatgcaaagggaaagttattgaaggacatttaaagtgctccagggaacacacaaatgataagaaagtgaaacagtcttattgctgatgtggagaaagtttgagtggtctggagagaaaaatcaaaccagcctcaacattcccttaggccaaagcctaacccagaacaaggccatagctctcttcagttttgtgaagacagagaggtgaggaagctgcagaagaaaaattggaagctagcaggggttggtttgtgagatttaaggaaagatgccgtccccataacataaaagtacaagataaagcagcaggtgctgatggagaaacttggtaagttattcagaagacctagctaggaacagtgacgagggtggctacagtaacaagaaatttgcagtgtagacgaaacagccttttatgggaagaagataccatctaggactttcctagttacggaggagaaatcaatgtctggtttcaaagcttcaaagggcaggctgactctcttgttaggggctaatggagctggtgactttaagttgaagccaacactcatttactgtgctgaaaatcttagggctcttaagaacgatgctaaatctactttgcctgtgctctgtaaatggaacagcaaagcctggatgacagctcttctgtttacagcatgttttactgaatatttcaagcctacttttgagacctgcagctcagaaaagaaaaattcctttgaaaatattactgcttatggacagtgcaccttgtcatgctagagctttgatgggaatgtacaaggagatgaatgtgggtttcatgcctgctagcacaacatccgttctgcagactgtggatgaaggtggacttttgaccatcaagtcccattatttaaggaatatatttcataagactatagttgccatggatgataattcctctgatggatctgggcaaagtaaatggaaaaccttctggaaaggattcaccattctagataccattaagaatgtttgtgggctgggcgcggtggctcacgcctgtaatcccaacactttgggaggctgaggtgggtggatcacaaggtcaggagatcgagaccatcctggctaacatggtgcaaccccatctccactaaaaatacaaaaaattagccgggcttggtggcgggtgcctgtagtcccagctactcggggggctgagtcaggagaagggcatgaacccaggaggcggagcttgcagtgagctgagatcgtgccactgcactccagcgtgggcgacagagcgagacaacatctcaaaaaaaaaaaaaagaatgtttgtgattcatgggaggagatcacaatatcaatattaacaggagttgggaagaagttgattccagccctcatggatgaggctggaggggttcaaggcatccacggaggaagttgctgctgatgtggtggaaacagcaagagaactagaattagaggtggatcctgaagatgtagctgaactgctgcaatctcatgatcaaacttgtccagatgaggatttgcttcttatagatgagcaaagcaagtggtgtgggacagcatctacttttggcaaagataccgtgaacattgttgaaatggcaacaaggccttagaatattgcatgaacttagctggtaaagctgtggcagggtttgggaggattgactccaattttgaaagaagttctactgtgggtaaaatgttatcaaacagcatcacatgctacagaaaagtctttcatgagaggaagagtccgttgatgcgccaggcttcactgctgtctcgtttgaagaaattgccacagtccccccagcctatagccccaccactccgatcagtccacagccatcaacatccaagcaggaccctccaccagcaaaaagactgtgactcactgaaggctcagatgatcaccttttttagcatgaagtatctttaaggtgtgtacatgttttttagacataatgctattgcacacttaatagactgcagtagagtataaacagaacttttatatgcactgggaaaccaaaacgtgtgtgacttgcaaattgcaatattcacttcattgtggtggtcgggaactgaacgtgcagtatctctgagacatgcctctctatcacaaggcccttcacattatgaaacaggtgatattgaacacaagagatattatcaaggggattttcacagaggggagagactgaaactgggaaaaatcaatatttccttccaatgcttgagtcctgtgatttaccaaaatatcacactttgccctgggccatcacactgagtgtgactttgagccaatggagtgacttcgggggacagtcgcagagaaggacgtgtgcgtctctgcacatcacgggcactcaggtcctcgggcactgccaggcgggtagctcttgccgcctacactaaacgcctcaagactagtttgctttctaagtttttaagtatttgtttttaatcttttaaaaaatctttttacatccctcaatctcaggctgttgcgaccgtttttgctgttgggtgtgcctgcttcgggtagatacttctcatctgttgcttgtggtctgctggcagggggaaaatctgaaaccactctgactagaatcacatcctagctgagagggggcagagggatggagggacatgtgtgagcatattccagggactgtgagagctgacccctggaggacagaagctgccccgtgagtagcctccatttaagtgagtgtctgcaaagcactgcagcctcaagagaaaggcagtccacccacctggcagatgggttgtttctgtgtgcactctcaccttgggctaagagaagcgtgatttgaaatcaagtgcaagaggccgcattttcacctctgtgagaaagacagacttttagaatttagaattcgatcaaacataacccccttgaggtcatcagagaaagtgtgcagagacacagcagcttgtcaggggccacaggtcacccatttctgttgtctcccaggagcctgttcacatcttatagcatatggtcacctggcccgagaatgtctgttttgcaaggtttgtcctgagctggctgtacaaccctctcctgccctggcttctctccaactcctactgtgtgtgtctgcagagctgcctggctcctcgagcctctaacccacctttagtttcacggcctatctcccatcctgactattacagatggtcatctgacattgtgtccagtctgtgagaacggcttccaatgagctgcccttggggtcccagaaccaatgtcaaaaagacatcccagaaattgtgaacataagctcattgctggtctctctgtgcaggccagtgcattttccctcaaccctgtctggcctctctgccacccagggcaaatcctgcattcctaccactctcaccgaccccaagcctcccagagttgaatcactggctgcatggttgaacctagtccccagccccctccactccccagaggtcagaaggctgagccgtcaccactggctcaaagccccaaccctcttatccccatgactggccttcccagcatggccagacccatcctggaaggatcttggggcccaccatgagtccacccaagaagcataagctcagctgtggtctgagaggttcaccatggtggcgaaaaccgtcccagtcactcaggaaactaaaacagtctggaagttccatctcagatcagatacattctttatgataaaccatcttatttggctatatctgtcagatttattcatattttcttttcaggtgggactttttcaacaactttggtttggtttcagaccacaccgattcagattgcagcagggggaataggaaatggggcttgggaggagtagaattgataactggcatttccgcctctaatggagattcggttattggagaactcaaatagaaatgacagctctgcccaggtgcagtggctcatgcttataatcccagcacttcgagaggccgaggttggggaggatcgcccaaggccaggagtttgagaccagcctggacagtatagtgaggccctgtctatacaaaaaataaataaaagaaacaaactattccttttctgattcaaaacttaattcacaattaaagagaaaacaagacgacatcctgggctcgcatttattctttatcgcactaatgtacaatgtagttgcagtctacattagaaatattagtatgcttataaatggtgcgtatgggttagagctgtttcttggggaactgaaagctcaaaacagcttaataaatttcaaaatgtaatgagtacatttttaaaattaaaaatatcaagtataattatggctttgtgttctgacctgtgtgggtcagcagtacctgatgtctgagagaccaaaagctggttagcggtgacccgggtcacactcagcatcccctcttcccggcactgcctggcagcgtttatggaggggcagccatccaggacagccccggaacagggtcctgctccggattcaggagacgtgaaggttcagtacagggcccgggcagctcatggttttaaggttgtagactcagccttggtagaaaccatgtagtagggttttgcagctttgtcactggttaagtcccagtaaaaactttttttttttttaactagtaacttatttaaagaatttattcgctttaattgcatttccatttcatagccttgctgatgtgttctttaccatttccatgggattttagtgagtggtttcaccacacttcctccaaatccccataactccagcagaagacataatgacaatgtaacctcatgctgtcaataaatgcggcaactgtgtggtctaagaatacatgcaggcattttcgctcataactctaaatggctagtgttggaaacattcccgttacatgtatcgggacttttcctgcatatgtggcatttccatgaccagcttctagttgtaaaaaacaaattgttgaccacgttttctcaattaaataatgtatgtgtaggccgggcatggtggctcacgcctgtaatcccagcactttgggaggccaaggcgggtgaatcacaaggtcaggagttcaagaccaacctggccaagatggtgtgaaaccccatctctactaaaaatacaaaaattagctgggcatggtggcaggcgcctataatcccacctactagggagactgaggcagagaattgcttgaacccaggaggcggaggttgcagtgagccgagcttgcatcacagcactccaggctgggcgacagagcgagacttggtcttataaaaaacagaaaataataatgtatgtgtaaacgtctgcgtcccctccccctatttatgtgacagcgtcagtacttgttttggtagctagcataagggttccatgaaattatgaccagaaaacaaagtaacactgtgaataatgaagctgggttttgtgtgtccttttctggggggaagagagttaatatttgtgtttgggcatattttatgttattcatttcccaaacatgacacagcaggacggtctgctgtaagagctcaggctcaccatggattctgacatgtgttttcctctttttccttttcatcccattcaattcaagtgaactgcctcattcacctcagaacctcctggtcagccctaattcttcccacagccacgccgtggtgctctcttgggtccggccctttgatggaaacagtcctattctttattacatcgtggagctctctgaaaacagtaagtagcaaaatgaaactgtcaccatggacgataatcagatttttgtgtgtgctcttaatgtccttaacctttacttctgggtcagacccaaaacaactactaaaatgctgtaatgctttacagggtttcaaacacagcctgccctttaggaaagaaaaaaccatgcaggacctgagagagggaagggaagaagtccttagttagaggggctcttggtggagagtggatttggggccccatgggagggctgtgcacacagggctgccccgcacagtgtcactcccagggcgagctggaaatgggttaacaatgcctgccacctgggtgacttgagagttcaccgtcgccgccactgctcatgtctgtgggaggttttctccggtgtagacgtggtgtcaagtgttcagcaccctcttcctgactcaccttccaggacccctctgcccatttaccgccatccttggaactcttctacatgaaacatgctccttccgtgggccactcacagccttggctctcctccagccgccaagccctccttcccttctcttcccagctggctgggtgacgtgtgccccgccgtgtgcacccactcacgcctctccgctctccctggaatctcttcctgggaaatcgcatgcactcctgtgattttaagtggcatattttccttgatgactcgaacatttgtatccttcacccaggattccaggatcacttatggggcccagcaacttgacatctgtatcgggttgtctcacggcctctccagcttaacttcttcccactgcatccatctttttaatgtttttttttttttttttttttttttacctcactcctgcagccacccaaatctctgctcccagcaccccgcatttctatattcctctgccagaaccctaggaatggtccccaattcctttccctggaccccagcccccacctccacaccccctgcatcagcagtcctatcagtctgttaactaggattctgatccctttcctctctgcctcagaccactggtacctctcgccaggaccactgcagcagccttccagccggccctgtttcctcatccaaaccattcacctgccagcagcaacactgatcttcctgagatatacccagaccaggccactcccctgtccacgtcctgcaggggttcctgctgcgtgcaatatagaagccaaatgcctcgctccctgtgcagcctcgggtcaccctgggctactgtgctctttctccacaccggtcagccacacgggacacatgaaactcaacacggattttatgttgactccctgaatgggccaaatatctcatctcatggcatgttccttcccctggaaacccatagagctagattgtcacccttcatgatagataatccattacctccacaaagaagctctccagcacgccagcccgatttcaccttttgttttttgtttgtttattttgagatggagtcttgctctgtcgcccaggctggagtgcagtggcatgatctcggctcactacaacctctgcctcctgggttcaagcgattcttctgcctcagcctcccgagtagctgggactacaggcacctgccaccacgcccagctaatttttgtatttttagtagatattggccaggctggtctcaaactcctggccttgtgatctgcccaccttggcctcccaaagtgctgggattacaggcatgagccaccgcgcctggcgtccagtttaaccttttaatacgtaagctgccggcctccctctgttatcctatctgtattagtcggttttcacactgccaataaagacacacccaagactgggcaatttacagaggaaagaggtttaatggagaactcacagttccacgtggctaggaaagcctcacaatcatggtggaaggtgaaagtcatgtctcacatggcggcagacaagagaagacagcttgtgcaggaaaactccccttgtactaaccctcagacctcgtgagacttgctgtcaggggaacagcacaggagagacctgcccccatgatccagttacctcccaccgggtccctcccacaactcatgggagttcaagatgagatttgggtggggacacaggtgacccacatcacccatcatttattccagatgagggtctccttccctgagcctcccccaggcagagccagatgcaggtatcctggctgttaacacgatccactttattcggcctgtggttgtctctggatgatactggtgttctaaacgggtccctgttttcaggacacctaggagtggtgcactctcgggtaccctcccctgaaacccagctccccgtgggtccctggtgctgctcacttttctgggcagattcagcctgagttctgccgtggctcttcccagctgatgtcagcctgtacacgcccccagcaattattgagataactcactttatttctcctaattacctttctacaccctcgcccttccctgggggttcccttctgataatactgcatgttcacaccacagccacacagtttaatccccatttcatagctacgggaatggatgtgcagaggctgtaagtcactgtcaactgcccagggtcacatggcgatgggaggggaagatgggatccctgtgctgtctgactccagagccggtgctcatgacgagtgtcaggcatccgcagaggagccttcggaagcagagtgtgctgtcctgcactacagcggggcttcagggagaggccacacttgggcgttggtctgtgtggacgtggaggaagccactctgtgaatctgaagaaccattatttgagttctgcaccacgcaaaccagttcaccgagggaaggcccagaggcagtatgttattccgggtcttaggcttctaaggttacaccttccagtcctgggcaccacctcggagtgaggccagagtccaggcccttctcccccttgcaggggcatctctgaggccggagtccaggcccttcttcccctgcggggggcctctgcaactcccactcgggcctctttcctcccagagatggggcaggatagaaaccagcgtgtgtgcagacggccatcttagcttccattcaacggctctgaccgaacggggaaggccagggtgttactgattcagataacttctgagagtacagaagagtttcctgaggatggcgtggccatgctgcctgtacgtaaaacaggacttgacagtgatctggacggagagaatgggacaggggagagctcgtgtcatctgaattctggttcgcatccaccctaaggacagcccccatcaggcgctgtcgcctcgggcttcaggactgtgtctcctttgtcttcgtgctcctcattccctgcacttagtacgtactcagcaaatgaggtgaaattcatctctccagtggagtcctcttgtgatgcactgaaaattacagtcatggaccgtcttccaaaacagaggcattctaccttcccccgtttccatgaaagaaggcatggctttgagatgcctggccagcgctcttctcagctgatggcatgactggctcctccagccagttagcttgcctccatgagaagcaggtttcgtgtgtaactatccagccagccacctacctgttacagcggtgaagccagctgggcatctgctctgcactctgctgggtgctgggtgcagagctgacgtgatcagtgtccactgcgaacagcaaggagacagtcagaggcatcgatgcagcctccacgtcgcacgttcccggctaggtacgtacatagtgatgtgactgtatagaaggcaagtcagagaaagtcttcaaagaagatgtgacatgagacctgggccagacgggcgacgagggacagcatcagcaaggacccctcagtgccaggcccccaggctcagtgggaaacaactgcccgtgagatggggctggggcgttgctggcggcgtgtattggtgttacctgggaaagttcttcctccttcttggtggcttggatcaaatatcacttctgcaagtcccattacgcccaggcagaaatggcttttccctcctcagggctcccttgctgttctacatgcttccctttgcgcacctgcgacgtaactcctggcttgtgtccatctcctggcaagactgggaaccccttcagggcaggtggggtccctgtgttggtcctctgtgctgtgacaccagcacagtgcctggcacacacaagatggctctgtaggtgtccagctgcttaatttcactcagaaggggacagagaacgtcagtcacccatattagcctctggctctcctgaagctggccgacgttcccagctgtctttccttcagagcctggagtgtgggtattgtggcatgcagaatctagagtgggtaccatggttgcctcctgcctgttctgatttccactgtgtgaaggaagcccgtgaccttggctgaagcagcctgtgctgctaccagctggttggtccgtgtcttcctgctgtggcaaataggaagagtaccaccatcatctgggccagtggtctggtttttatttttattagcaacaaatgcccttaagaagcagctgaacatgctggctaattagagccagaaagaacagcttagcagcaagtgcactaaaatggaaattgcacttggcctccactcagcgtgtgcaagtggtcagcactaaatagcgccatctactaggtctgtccctccggctacttgggagacactccacagccagctcctcctggcaggctgactgggatgccattctcctggaagccggggatcctgcaggggccaaacccacatggtttagtggccgaggcaggcacttgatagcctctgccctgacgacattcctgccactgcagaagggcctcttccgagctctgtggagcagagcctggggcttgaactgagcctgcacccatgtacgggactcaaggtgcatctctggatgggagatacacgtggccctctgcaggcatgccagggtttgcctctctgagaagtttgatggttctcctgtcccaggtgcctgtttagtaagcctgggactcagagaggggcagtagtgtcctaggcctgggtcaaggcacccacctggtggattgaggagggcagagggtcaggccaggtggcggatgagggaagcctgggggatccctgcattgagagagtgcagggattcttgatggcttgacagtggggaccctgtgaccaggctgagaattctgttgaataatgaaagcatttggcccactctctaaaatgcttatcgattatgatcaaaaatgatctttctttgagattattatgatcctgtggagggagactgtcaggtaagaattgtgaaagactttgcagtgtgccataaaaaggattactgagtgtctcatctagcgcccttcagggttatctgattcgatagggacccgcgctttccatcgtctttgggctacttatctctgtaaattgtagaaatcttatagtagtgcactttgagtaatgcaaatttcttttccaaagaaatgcaaataaatgcaaattttatcctgtagaatataaatatggctattgctctgcagatactgacccgttttgcatctatttataaattcatttttgcactatcaatatgttgtgggctgttcactttctcttttgatacagttgaaacgtcttactggttccctcataaattaatgacaactaaaatctttgatacatgttgattctatcgttgcattagagccgttattttaccttcttaaaaatttattctttcacatgagtgagtcggcattgcacagtgttagaaatggagattttcgtttaatgcaacagttgccaccagtttccacggcaaccttgatatttgggagaggccatcctagttctcaaactgagcctctgcgtgttttccttgggctggacaaaggcgtcccatggctgaaacagaagaatggtggccttctaccagttatcaagaaaaattaagtctttttcttatgatttttttttcaaccttaacacctgctgttgtatgtcttgtggtaaatgcttgcaggtaacaaacatattaaacattcagaatccttcattctactcagtcctacggttagttttttaataggatgagtgttcgtaattgtgattccctattataccttgtaatatttaaatttaattaaaatgtaaaatacatttgtactttttattattctagttatgcatgctgattaataaaaatttagaaatcccttaaagcacaaagaataaaaacgatcactacagtcccacatatgttgaaagccagccctgcacccaagcccttggtccctcctccagcccttcctccaggacttggctccctctttatttcctctctgtgttctgtcttcaaagctctccctctctcctggcttcttctgcctcaaaggactgagctctgctaattacctgcacctcctcacttctcacgcattctatctactcttctctcctgaggccatattgtcgttgttgtaaaggacagagccagtgagctccactgagtccacatcccctcagcttctctgcaagcaatgctcttgatcactctccccacacagacctccttgttcccaggacttggcttaagtctttctcttcattcttccttcttattttctcctctctatccattttctctgactcattgaaggctctatttcccctcctgcccctaaaatgttggcattccctgctttgtctcactcacacactggtcttcttatcacacatgcttttctagggatctcatgttagtccatggttcacctttgacccacacaccataagtccctcatgtgtatttctaacctagacctctctgctaagcctcagattcttgtaaccaaatgtcttccacacatctacacctccatgtcccagggcttatcagactccaactctaaaatagaactcatcatctgaccccaaagttgttcctcttccaagttagagataatgtccaggctgggcgcagtggctcacacctgtgttctcagtactttgggaggccgagtcaggaggatcacttgaggccaggagtttgagaccagcctgggcaacatagcaagaccccatatctacaaaaaattaaaaaattagccaggtgtggtggctcatgcctataatcccagctactcaggaggctaaggtgggaggatcacttgaacccaggagttcaaggctgcagtgagccgcgatcgcaccaaggcactccagcctgggagacagaatgagacttcatctcaaaaaaaaaaaaaaaaagagaaaaacataatgtaattcttgactccttcaccattaattctctccaacaaatcaatcaataaattttatagggtttacctcatgcatttttatcaaatccactgccctgcccttctttgttcctgccaccactgaccctaactggctgttgcccatcactgtgatccatggatctgggatcctcaaatccatcctcccttgagccaccagagcgagctcagtagtacaggaacctcactgagtggtttcccctgcctgaagccttccagaggatctgcagagaacccaccgctggggctgggcaggaaggcttcaggaagcctggtactgtagacatggcccatgtcctccctaggttgccagccctacttcttccgtatagaggttctcgttccctgaagaggggattctaggcttcttagcatggtagcagcactgtttactatctgaccaccccctgcctctccgatttatctccagccactcaccattctgctttccttacttcagcaacaaggcattcctccggattccctgggcacaccagatattcagtgccactgcacctttgctcaccgaatctgggaattctcgccctgatcctgtccccctctgcctttgcctgatcagctcttactcagcatctccttttaggcattgcctctggtctcaaggtgctaccccatctcctcccctaggggtgccacacccaccccctcccctgggagcgctgtccccatcccctcccttgggggcgctgtccttatctcttcctctacttgcgttgtccccatcccctcccctgggggcgctgaccccaacacctccctcctgagttgcctcagcagtgctgaatcaaccaatgggcaaacagcctttagggcaccagcaaaggcaagacagcaacactaatgcaactatctagaaggcaatcatttgaataatctttctactccaactacacgaagataccctcctgtgtcttcattcaggaggttgagggttctgagtttcgggtcttctgagggttgttttagtttgtgtttcgactgctagtattcttgaacccattctgccaagtcggttggctttgagcactttctctgctatgatctgttcattttctttgccccatttatctatccaaggccttagggattttttttttttctgtcatttgtaacaaggattttttcagtttgcttttaccattaatgtttgtatattactttctgacatacagaagtgtttgacttttacgtagttaaatctattgatgttttcctttgtcacttcattacttttgtgtttggatatttcaacactctcaagcctaaaatgagtattcttataggtttttgccttgtttataaaggtttaatttttaatatatttaactctctaatttttctggaatttaggtgtgttatatactctggcacactacttttcctttctttcaaatgatccattttcccaacatgatttattaaataatctatttatttatggtgtctccctctttttatattcagaggacctgtttatacaaaagtctgcttgtggattatttagttccattgattcattatctctttttctgccagttttatagtattttaattgctttacttccaaaaggtgttttaataactgataaaacaactctcttcaacttttcagaattttgttattacttgtcatcatttattcttccagaaaaaactgaaattattttgtttcaaaagtagtctcattgcatttttaatcatgttaaacctataaattgttttatgagaagtgacttcttagtaattctggttttccgtccagaaaataatatgcatccctatttattcagctgtttagtgaggtttgcaagtttatacccataggctgtatacttttttgtcaaggttgtcctgagattttgactcattgctactgtaaatagcaatttttccccatttcgtcttctaattagttattgtaggaacataggaaaaccactgatgtttagatatttattttccattcagccatattccatattcttttattattctaacgacttttccattgctcttctttgctttcaaggtagacgatcatatcttttccaaataatacaaatgtattgttttctttttgtttttcctatcttgctgtgttggttggaataattttaaataattggcatagtaatgtctcttgtgtttttcctgatctcagtggaatgtctactaggattttactgttatgtgtaatatagattgttttttattgagatataatttgtatgtaacaaaatgcagggagcttaagggagttttgacaaatatatacagccatatagcccacacctcaaacaaaatacaagtcatttacaatactccagaaagttcttcctggccctttctagtcagtctaaccccttcttctgacttctgtcaccatagattaggttttcttgtttttgaacttattggaaattgttacgggatctttggagtgtcgcttttccagccagaaacctctgtggctggtggcggttttgtccgagttctcgtcttgtatccaggaagaataaggttcacagacaaatggagggtgaggaagatgaagaggagctttattgagtgtccggacagcccagaggagccccgcagtgggtggctgctctctgtaggcaagtcgtcccatcgtctctgcagctctcagcagagaggaggcctggagtggaatttaggtgtgttatatacacctctgctggcagctcatcccgacaagtgttcagctgtcagcagagagaaggccctggagaggatagtagcttctctctgcggctggtcgtcccagcatctgcagctctcagcagagagaaggccttggagaggttgttcaatgtctgcagctctcagcagagggtagctcctctttacagctggtcctcctgtcatctgctcagctctggctgagcccagggtttttatggccttcagaggggaggaagtgcatgcggattggtcaatgggtgaccatgagtgggcctggaaaaggcaccacaagttcccactccagccagggggactggcagccctgcccccagcctccaggccctcactggcctgaaggtggggcctcaccggagacccaccttcttctgcccaggagtctgtctgcctcctgctgccattcatggcactcatgctcgccctgactttgcccccagatcagagtgggtgccaacagcagggagcagccaagcagtgagagcaggcacttccaagcctgcgagggcagggggtcttcctgggtccccaagagtgcaagaatgcctgagtctgcagccgcgggttttggcagctgcagctgtgcccaagagggcagggatcctgcctgctcccagcccgccaagagcacaaggaggctaggatctgcagccacgacttgggcagggctcctgcctgctccatggaatgggaggcccaggtctgcagccacggtttgggcatctgcagcggcaccccgggagctcccgccccaactcgtaaggggcagagcttccacttgtccccggctcctatgggctccttggagcaagcggccccggcagcacctccctgcaacagctggcatgatggcagcggcaggctgtctagagcagctggctgctgtcatcaaaaggaacatgatactgacttgaatgagcagttttgtttatcatgtaatacattccttccattcccacttcttaggattttttaaaattatgtaggaaaatgttttatttctaagcaaattattcttaaaataacaaaatattacatttagaaatacccctacgtttatgtgagagaattcagaagatcaatacgcttcagcttttgggaattcatgcattcccaaggccctgccccctggacaggtttcagagctgatgctctgagggacgtggtcttcatctatgactctaggttccccagcctcaaacctgaaataatgtacttttccttaactcagaaagaagccctgttttctatgaattaggagttaatcccatatcttcatgttttctaacaatgtgcgggaggaacaacacctccgtatcttccgcatcgctcgctgtcttccacgtggagttccgtgcagtcggcgtctccactgcctagggagtgctggcttctctgggtgaatgtgggagcttccttttgcaagtgtgccatccatgtgtccctttatgccttggctaccaggaagcccaaagctaacctgagtgtctaactgaagtacctcagtcattccaactgcttagaacatctccatctctttgcattcttctcctttatgagtttgattttgtttttgtttgtatgtatgtcattgtatcacccaattttatgcagattttcactttagaatatccttaagctctctttaaaaataggagatatctctccccaaacacacacacacacacgcacacacacatgtatcatgtcaccatactttaagggcaggctcatgtgaaatgagccatcgaccttctttctctcctttagtttctttctccccattcccttgggtacagagcacagtcagttcacgcaagtctgcaaattgcgcatccactccctcctgagagcattagacaccaggagataccaggaagagcgtgaggtccattttcgaggcaaagaacactcacaaaattaaatcacaaatccaagaatatacgagggggcgtcgggtagtatgtgatcgcttgccaggaaagtggatctgaggatcaagaccgtcagggaaggggggttccctgtgggcaggtgtgggcatggaggcccttggaggtggaccctgagcagaatgttcaaacggtcagtattcggatgccctggtgcctcggggcgggggaggctggtggccaaggactccgaggcttggatgcagggcagcaaaatgggagttcaggaaatttcccagtgagtgaattcgtaagagcagaaggatctttgagcaggagaagctggaggctggaggctgaaatggactgctttataaaaaaccattttctaactaataatgtatttttaagtacaaagtaatacatgctcattgaagctggagaaatagtagatgatgtataaagggagagttcttatctccccccaccatgagggagcactgctagcagcctcgggtgcatcattcctggctgaaaagggatgcctgcgagggacagagagggaccaaatgatgccagacccgagtcttgtacaacaaagagctgcacaaagctgggagctaggcaaggtggtgtgaaagcaagtttttagcaagattaacctggcagtggcctacagggagctgtctgtgaggctcagagagtgaaggaaagcaggaggctgagggcctggagcaggaaggtggtcattcccgaattgctgatggggtttccctgggaaggagggggcccaagatggcctagagccccaggcctggacgtggaagtaggaggcctgctgaggaaaccggtctgggaagagcatctgtgagcttgactagagcatgctgaggctgagatgatgttctggggttcaggttgcaatatcctccaggcagcttgtccttcctccagcatggaacgttctggtgcccccagcggcctgatgcttttttgtgcctctccgcctctgctttctgaagcacggcttggttttgtcagctgctgggccaagactagcttttggagcacgttctctgagtcccagtgcctctcctgagcccctccccagcatctttgcaggagaggttcttcctccacaaagagaatctctgagctgcacggctgggttggttcttcccctgccacaggtgccttttcatgtagggaacccgtcagccgtctccacgccgctctccatgaaagctgctcctggctgtcaccgcacaatctgttcaacatctccatcccctgttgctattatggacttaaaagctgatgggcgttgtgctgttttgcttgccaaaatggcgaagagactttgttcttcatgcttcaaatattttaatactgtctttgaaacacacctcacacaggcgttttctaatggcctcggacttttcggggagcatttcatattttagctcgtctttctttgggcttttgctttttaagcctcccatgcatagcatttgtccgcattttaataaatgcacatctagggagacagtacctgtcagaggtgtttatgaaggggggaccatggctgtgttgggggcccagagggggctgaggtctgcttctgcgttcacttcctgttagcttcctgccctcaccaagacgagatgggggtcagagagcccagggtggctcccacatccttggttggtcctcaccttctggaatcctctggcccaggctgtcccacaggatggtgtaacttcctgcgtgggagtgcctgtggtgaccgcacggtgcggaatacagcgtggctcccatagcttgagctccaggaggtcaggccagcttccatctggagaggggcccctgctccacccactgcctgccagctatctccagcctgttgcaggggtttgccaccattaggattggtctcccacccaagatcgagttccccaagcttctggatatatccagtcaccatttccaacctcctgccccttctctggagggaatggcttctccagcacataggcccacatctcccggtgagcatgtgtctccccttgggtccaggtcaaagtctggcctcggtgggccacctttggtgtcttgacctgaggctctggaggccacagtgccctggatgtaagcagtctacggcctcaaagcctgttgtgggatcatttgggctgcatccattagctgggggtttcatgtatttctaaatgtctcagctctttagttcttaactttttaagacaaaaacttggtgcattttaatcctgagcttgtagacctttatggtttctctaaagacatatacaacagagaaagtcttcccaaagggaaggatatcaaaatgtatttatactgtccactctgtggtgttttgttttaggtagaaagtatccatctacttcgtactctttcttccccctgttctatgaagtctttgtctggcctaagcctctttctttctcaggcgtcctcagtggtttatccctgtcactcctgtggcctctgtcttctcttccagggttgccaccacgaacaggtctctctcacaatgttcttttcaaattgtgtttgtcttagatgtgtttcatgcctgaatagagtcacattcatctgggggccctcgcagtcccctgcaggagtacagtctgttctacaaatgtatttaccagcttaagcttggaattctacagtgccactaaaaattatgttccttttgtcactgtcagagtttttaactagaatcctgcagaaaacactttatataacctttgcataacgagttattatctatgcttctctcttagtgcccagatgagctctgactagaccaagagaagctttttcgtagccctggctgtgcccgtctctgagtctgggctccagccggaggggtgagtggctcagagcaggagtgggttccgaagcctcaccccaagcagtttaactgcatggaggctgaaattctttgttgtctgggctttcaaaactgtgttatttctgttcatgtgacgacagtaatttaagggcgctttaatatagaggaggaaatgtcattccttccaccaaactaatctcagtaactcactgagctgaacactaagatacaggtcggagtctccaaaaacgtgaaagtaattacccaaagcattgaacaacaatgagaatggtttaaaaaacaagaactgcagtatggacctatgcctgtttcatttcagttccttcccatactctttattttccaaaaattttaagtgaacttctatcattttttatggtataaataatgtacatacacaaacatatatatacacaaatacatatacacacaaaatatacataaaatttaccattttttacccctttaaggtggaaaaaaatctggttgggagatggatatctggttctcaggggtggatccaggttttgttgtgtaatttcggagctcttgttaagaaaaataatacaaaattgaaagagcctctgctgggacccggggagggcccgatgtgatgggagccaagagctccaggtcgctctgttcatctttcttctggggttggcatgagcttccttcccagagggcactgggcagtgctgtttgcagctcatggagccctagccctttgctactgctccaccccatgggcatcaggccccccaacactgaggagttcagcatgagccatgtctgggacagctcattctccaggctctagcctcaaggaggaatcccagtggctttaaccccagctctctgacagccctcactcttgtgtgcctgggcacacgcatgtggacacatacacacagatctgctcttctcatgcaaaacacatgaccttccactgcaggttccacgcagggcctcctaacctgcccctcccctgcctgctccagaccaaccactcatggtaggtctttcttttttcttactaaacttggtgttttagagcagtttggagcttacagaactgtttcaaagatggacccgccacccagcttcccctgtgacactagtatggtgcctttgtccattcattgagcccacagtgacaccttattgttcactgcagtcactgcccccttccgagctccgcagtctctccctgatgacgtctttcccgctctgttgcaggatcccgtccaggatctgttttgtagaacgtcactcaatcgggatttgtctgatgttcttctcttagctagaccaggattatggggctttgggaagaagaccagggaggtaaagcgccattctcatcacatcacatcacatcaagggtgaaccctgtcaacgtgactcatcactgctgatgcttgctagaccttccagacacggggaatttaacctgatctgtgcctagggctagactctcagcagcacctgtcttgagtgtgcagtgccaccctaaggaatgcagcctgcttatactcagtgtctagagagacagtctgttgtggtggaggggagcctctgattagcgtgaagcctccccacttagctccatgttgggggccctcgcgggcattgctccaagacaagctcatcttctccttcatctctgtgaccaagcccttaactttgcagctttaaatcctaggcaacaatgagatgtggagtttgcacaaggagcattaatggagagtggagagaccctgagccttcactccatccatttctcatgtggaaatgaagatcattttatccccctcaaggttactgtgaaagttgaacgtggacacatacagccatcagcagtagctccaagagtgggtgcttttgttccacaaacacttattgagctcctactgtgtgtcaggcactcttctagttgctgaggaccaaacagggaataaaatagatcccaagggagctcagccagtggataactcttttcatggatcaccatgattattgtgagctaatacttatatttcaggagattcaacatgcagactgttgtagcaaaaacagtagtagaattcaaattagaaaaataataaatttgcacctaatttttccacttaactgtaacctgggggaactatccttattttaatgaaagcatgctcattctcattcatataaaaatgcaaagtaaagcatcaaccaaattacatttttcacccaccaatagacaattacaacagttataaaatgctccatgctggcaatgctatgacaaaaatagacactttctaagaactttttattattagaagtactaaatacacacaaaaatatagctccaacaaccagtaacattttaaccatatttatttcatctgttcctcactttccttttgctagagtgttttaaaggaaattccagaaattatgtcaattcatccctaagtgatcagtaagcagttcaaaaagttgattacacctaacaaaattaatagtagtcattaatatcacctgctattcagtctatatttaattttccctaagtgtctaaaaagaaaggtctttttacacttgcatcaggatccaaacatggtccatccatcgtactggttgttttgtgtctcactgtgtcttcatccacaaaacccccttctacctccccgcttcctgcttgggcagagtccatgacagttgtcctatagaaggccccaagtcctagattaggattctggtaattctggtgtttaattggttcctgcacctttttttttttttttttttttttttgagacggagtcttgctgtgtcaccaggctgtagtgcagtggcttcatcttggctcactgcaacctccatctcctgggttcaagcgattctcctgcctcagcctcccaagtagctgggaatacaggtgcatgacaccacgcctggctaattttttgtatttttagtagagacagggttttaccatgttggccaggatggtcttgatctcttgacgtcgtgatccacctgcctcggcctcccaaagtgctgggattactgcaccttctttattgcctggagactggatttgagctgccttccgtttccgggtagtttcttttcttatgtgagtgtgtgtgtgtgtgtgtgtgtgtgtgtgtgtgtgtgtgtgtgttaatacttcttgggtattgcaggtacttcctgctgcatcacccaaggaggcacatgacaccagctgccccgcttctggtgatgttgagatggagccactctaggtagccgccacctgtgaaattcagcagaagttatttaaacttccctgagtcttggtttcctggagtgaaaaagaggcgcagtaagacctcctccccaagcgggtttctgtggctacagacccgaaagcacttccaggcggcaaactgccacagaaatattatgtattaataatatgatgatgcttttggcaattaaggaaaatctccctgctgggcttggtggttcactcctgtaatctcaacactttgggaggccaaggcagacagattgcttgagtccaggtgttcaagacaagcctgagccacgtggcgaaatcccgtctctacaaaaaatacaaaaattagccgggcacggtggcacacacctgtggtcccagcctgggggatggaatgtattgtgggaggtaggggtggaaaagaacatgactaaggcaggaggatcgcttgaacccaggagcggaggttgcagtgagccgagattgcgccactgcactccagcctggatgacaaagcgggaccctgtctcaaaaaagaaaagaaaaaaataccttctttcaaaaaacatgttcctccttcagacacctttaattgagaaactgataatgctcttttttattggaaaaagcttccagtacattttcaaagattggaaaccaccagctttttcaaccaacagctaaagcggggttgtgattcattcctcgtgattctcggccttaccactaagaaaacgaaagtgtagtgatgccctctgtagaacggagcctggctggggaagtgtaaaatccctcagtcttctagatctgagagtccctgaaggggaggaaaaaaggtattaaacgtttatgggatggtttcctttatcaaaagattcttctacctcccagcctccaagacaagcatcctgtggccctcttctgtgaggaccggctgggggcggacccttttaaagggatgttgcttattgattgtcaggaacagacttgctatttaaattttaacagttctcagcaagcttgcaattccagagcttgagaatgagcaaatccttcccaaaacaatttttttttgtatgaatcagggtgcccagagatggatcagttcatttgtattagttttcactttaatctctcttccagccagaccttttattttctagtgaaagaggaaaaagaataaagaaagaattcctatagctgcagcaggactgggcaggccccgagatgcagaggtaattaataggccctgttgtcaaatcaaaccaggcagcagactctgaaccctgaggctggggttctggactttcaggagctgtttacactcggagtgaacaaacagccaggatcaggcagggccaggctggcgggatggggccgagggcgggaaagcggcgtctccaggcttgctctgcctctcccgcagtctgattaatcgcctcagtcacctggtttcaacagttgtcctcttgactgtctctttctgaaacgatgtttgttcactgtgcctgacggagcaggtgaatggctgactgctagacactgtgatgtctgaaggaagaaagggatggacgaagagctttactgagtccagtatcagtcaagcttcctgagggaaaagatggcgttcctgaatgagagcaatcaaggaggaagttttagaaggggaatgtttgcagaggtgcgggtggaggggaaccactgttaccgggggctggtagcctcagagcgggtttcactctaaggttcaagagcccgaggcagttgcagaaccccagaaggagagattatgtagggtggctgcttggaaaagagggggacccaggtagccccaggcagcctcccagtgaggaagaaagagccttacatttgctcccctcatctacaggaagcctcggggcaggagtcccgaggacagagctggatagggagggcggagcttggatctagggagagcaagctgtccagcaccctgggccaagcttacagctagatgctttcaatgtatgtgatttcatactcggggagtcttgggggttatatattatcaccccatcttttcattatttcctttaatttgttttttgagacagagtcttgctctgtcgcccaggctggagtccagtggcgcggtctcgactccctacaacctccgcctcccgggtttcagcaattctctgtctcagcctcctgagtagctgcgattacaggcacctgccaccacgcccggctaatttttttgtatttttagtagaggcggggtttcaccgtcttggccaggctggtcttgaactcctgacctcgtgatccacctgcctcagcctccaaaagtgcagggattacaggcattgttttaatctttaatggtagtgaaacacacataaaaaatccatcatgttcaccatttgtaagtgcacggctcagtggcattaaacacattcacactgttctgccaccgtcaccaccatccttctctagagctcttttcatgttgcaaaacttctgcaccactaaacagtcgctccccgttgccctttcccctgctcctcctactttctgtctctgtgaatttgttctagatgtctcatgcaagtggaatcatacagtatttgtctttttgtgacttatttcatgtagtatactgtcctcaaggttcatccatgttccgccatgtgtcctaatttccttcctttaagaagctgaatagtagacattgtatggacagatcgtatttgtttacccattcatccatcggtgggcagttgggtttgttaggaataacgctcaaaatcctaaggaaagtgaacacacgaacaaaagattcttagcaaagcaattttacttctgcgcagaggggtgcctccttggccagtcgccatgacagcacacctgaacaaaggggcacgagagcctttattcctgacgcaagtcctgcccctgtaccctttccccattggccggggtcgggtcatacaatctaaactaatcccggttggctgaacctttgattttttttagataaggtgggcacgtaaaagaaagcgaagaggaaaggggaaggggtgttctgtaatgaactagaaagttagtcctctttccaaataaaggaaggaatgtgagctgctactgataatgcctggtactgtggcatgcctgggcatctaacaaaggcaaaaaggaaaaaaagggaaagggcagcagggggaagggtactataaattaaagaataaaagattgattgggttctttgaagagaaacctcatcatatccctcaggttgcttctaccttttggctactgtgaataaagctgctttgaacccaggtatgcacatatctcttcgaacccctcctttctgttcctttgagtgtatactgagaagcagaattgctggattctatggtaattctgtcttaattttttgaagagccaccatactgttgtctgtagcggctataccattttatattcagaacaaccgcgaaatggggcggaatttcttcacatccttcccaacacctgttattttctgtttgtgtgtatgtgttttcttttcataatagccaccctagtgggtattagatgcaatatcattgtggttctgttttgtccactgttttcacggaagttcaaacaaaactgaacacccttaagtgggagagctcgtagtcagctgtggtctccatgcttctttcttctacataccagttctcttcagaatgagaacggtatttccatggaagctggacttggcacgaaggggccctgccttctaccaaccgagtctggttgccctgatactgggaatggcctttcgtcttctgcattgacaaatggctgttttctgtaagggagactgcttagcaaaccagatcaccatgagctgcatgatacaagtggaagggttttaggctcccagagtaaaaagggaagttgctgtgagttcttctgtaggtaactgggaatgcgcacattttgtttttaaaggagacacacagagagggggatcctcatcagctgcccattatccatgtcactggaaatcaaaagccaagaacgctgaaatgcccagctggtggcgaagactgcgttcccagaaagccatttttggaagcagcttgatttgaaataattaaaaagatcccatcttcatcgccaactggcttcatgcttcagagcagcttaactttgtgttaaggaatccagtgagcagattctgaattagtgatagacacctctgtgtgaggcaacagaagtttcctttgagagtctcattttcattttggagcaatttatggccactgcttggtgattggtaaggagctggagtgcatttccaatgagctcgcaggcgcagacttacgaatccccgcggttggggctgcaggtttttggagaagcggctgggattttatgtgtggatgctgacacgcagctggtactgtctgcaggctctgcctagcccaacactatggtggaaagcatgtgccacctctttctgaccatctctaatgtgggtgaaagggaccttagcgccacttcaggtcagcgagacagctcgatttccagaagaatttcccccacccaggttttacttcgctagtaacttgaaaattcagttcaggcatcatcacaattcagaatgggaaccgacagcggatgctggaagtcactgccaagactttgttcattccagggcatcagtctacaaaatgactgggctgaaaagcctgtttaaactctgcaaaaaatccacgcaagggtgtaggatctccagcagaaccttcggaagccttgccggcaagagtgcatttggctggcagagtccctcttgcacacctgctggaaagctgggtgggaagatattctaagctcgctgtgaatttcattacgcctctctccagccaaagccactcaagggtgtggtggtgtaatgggcctgccacgcagatgggctgcgaaatacacagcccatctgtctttatcatgctcatttcctcttttattaaaatgttaatgaatatagtttttatttatcattcagtgacatgtgcagcatccttttctgggagacaaatctgcaatctgcctaaccatgtgagccgacggagaactttctccccttacatactgaacacaggaattagggacgttttggttccttttaaaccgccgtatgcaggttgcacaaaaaaatccttttgctcattgatggcggcaccggggaagttgcctttctggcttgtaagttactagccacatggccagagcctcagtttccacacctgctaaatgggataagctttccttctcctagagctgtcctgctaagcaaatgagatgttccctgagaaagcctttgcattcacctcttattattcagacatgataagcctgtgggcttgaattcgttttcttcattctttcagactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggtgcgtgaatcccgccccaggtgggggtgtggaacagccgggggcctgaatgccaaagagaagcatcacattatgtggtggaattgatcacagcaacccgctggcttccctcagggagacgggacaaaccgtgagcagaaaagcctgtcgcaaagagggaaagacaggcccacgcagacttagctgggccttccttcattgctttgaggcaggttccttggatttttcctgtggcgatctggctgtgcctacataaatcgctcctgacagcacagccctctgtgtacaggaaattcagagctcacatgttttccgtgttctttgtccaccccactgccgggtggacgctgatgccacagtcttagcaagtcaacacctagcatgctgttaagggaagctgtctctgcagaggcgtcgcattcctgagcggtcttcacgctctcccatccctgcgagggccacctctgaaaaatctcattcggaggtgacatgggaaaatggcttcatcacatttcagcacaccttccccaaccaacctgagctttcagtgggcttgacttgtagaacagctgagctgtaaatgcctttctttttttttcttcaaaatgtgggagtttgatatgagaaatattgaaagagccggagaaaacagtttgggaggagtctgagacggcaggccgacgagcggacgcattcaggcttgcagtctttctaaagggctgaggtgctggggttattcacacagaacaaagtcacctccacctttcctcgttgcttggttaactgattttctattatgttgatttgtggtaactgtttctcacgtcctttcagtttcattggctgtgtgttttgcttttcctgaaacccgatttttgtgaatagtcaggctcaagattcagcaagatagatgaaatgcaaatgggcccccgctgtttctggtactcatctctcttgttcctacccgtcttttatttataggttgatgctacctgaagaaccacccagtgctcccccgaaaaatatagtggccagtgggcggactaatcagtccattatggtccagtggcagccacccccagaaacagagcacaacggggtgttgcgtggatacatcctcaggcaagtgccctgtgattggccatctttaggccgccattagagttgagcgtcgatttcacagagggttgcaaactctaatgtctgtaagagccaaacaggaaccaaaggagtcaggccaggtgtgagatgttagggagtggtggagactgtggcaaactggagtgcacaggccaacgtgggcagccgtgcagagacattctgtgcatatctgaccataaatgacacacacaaaactggtgtcagggtagcattttggcaggagaatggagggggtattaggggttggaagcaaggtatattgttcaatgtgaagctttttttttttttttttttttttttttttttttttttttttttgatggagtttctctcttgttgcccaggctggagtgcagtggcacaatcttggctcaatgcaacttccgctgcctgggttcaagcaattctcctgcctcagcctcccgagtagctgggattacaggcatgtgccaccacacctggctaatttttgcatttttggtagagacagggtttcaccatggtgaccaagctggtctcaaactcctgacctcaggtgacctgtcctcctcagcctcccaatcctcagctgggattacaggcgtgaggcactgcacctggcctcattgtaggtcttttgattccatttaagttttcaaccaagggcatgtgttgttcaatacagtaattttaaattaagaataattaatttcatgtaattattagccagttgtcaccatgctggtatgttgcttgctatttccagaaatccaaagatctagctttgtacctgaaacctcccaacttttagatgttggaaatgaaatcaatatatttggaaacaaagggcagggctaacacacacttctgcaggccagatgtggctgaagggtagccagtgtgctgtctttgctttataaaggacagttaggcttctagaattattgggaacactgtatctgaacttgtctgtgtttgagagaagaaacctcctttgccaaaactgctaattttaaaattgcactgaacgcgatcattgcagtagcctgttgacacaagtaaaagcaaaagtaaagcagaattgcataataattattaaatctcttctaatagattgcaccactgtggacatatttgttcattttaccagtgatattgggacaagaacagtgggtatccgcttattcccttcctgggctcgttccaagtgtgtgatcagtaaacagtggctaacaaaggtcttcagcagacagatgtaatttcttagataaatgtgagaaattgggaaatgttgcatcttcagcttcattatccttgtgtatgaagggcaacgccttccctgtatatatgtgtatagccatccattcatcatttaatatgtgtttttctatgtgcctggactatttgcctgtcaaaaccaatttgccgctgtttacaagtttttcctccagcgtcgggattctcttctaaatgtaagccagaccgtgacccacctgaagtggtttaaatgggccatccccaggggtacacaaatagctccaatcaatagcaaggccccttttgtctcgaggctccaactgtccttcctcatttcaaagaagggggaagaggagcttgcagttctgtcccctcggggtgggggccgcaggctctggttcctgttgatcccctgggacagttcctaattgcctgaccacctccgctccagaaaacagccccgtgtccccgccgcctgcggccgagggctcctgtggcactgctgctcttgcccctgccttagccattacctctcattctgcacccatccactaatgagaataattggctgccctctgtacccagcagcacaggcctgtcatccctctgcctctgcctttcttcagcatgtgcaggaagagtttccttaggctgaagccgtcaagtaaggactttaaaagtcatcccacagaaccaggcccggggcacagagtttaataataaaacctctctgatgttacgaggccacttcggggactgcacatttctctgttttgtgggattactactgttaaaaggattttctgtgatggggtcagtagagttgggtgctggagatgagggcatcttctgtatttgcaggagcttaaatccagaaagctccaagatgagggtgcagtaccctaggcctgtgaatatcaaagttttcagaaatgaaagagccatgccaaagtgaatttgcttaaaaacatttccgcataatcctctggtctgcacatcagctctctgtttgcgagtgtgtatcctccagggcacagtctctgtgtcagatccgaggcacaatgcaaggaaagcaaagagaaataaatcacttccgtggctccagccataagaagtagttaggacgcgtgtgcagtaataaaatatttataataatagggagggtgtttctttgagaggagcataggggttatgtcctttataaacgttctcctgtttatttttgtataaaaaatcatcttgttctggctgagatggtctcctgggcaacatatcctaccagcaagaggaggctgccctgcacttccgttattgactgtgaccttcttagacatcctgtgactatcacaaaagcacccggagccactggtcagaatgggccaacgtgactgttccggaggggagcgcaggctctttggaagatgtaaattctgcagtttgttattcacagtgctgttaagagtggccccagagaagttgggtggctcatgcaggtgtagttccttataactcatagttatctctaccatacttctcggtagaagagcagtgtttaaaaatgtatatatatttagggagtgctttacaccttcacatctcttttacattcagtgtctcctttgactcttgcaacaagaatggaaatgctactgtcgtacccaccttaaagaggtggaaaccaaggctcagagaagtttggaattttcccaacaccacccagcttctgagtggccgttgagcaaagtcttccgatgctggttcctcagctcttccctggaatgtgcattgtgtagcgttgggtccacatgaggaatccttcttaaacggcatcctcattctgtcatagtgattacagatggtgcttggtgccagcatgcccaggctactcaggtgcatggtgtgggcacagagccagtttctaccttttcccaaatggctgtctcagtcccatttattttaagcgttcatcttttgtagatggtgaatgtaagtggaaatacctgtcacacaggtgaatccatgccaagcctttctcccagtggcccaccgccttgaggaccatcatgctacgtcggtgatctgaacaccacctgagaattgcacgtgtacttgcttggtgcaggtcgttcagtaaaggagtcagtgatggacacactaggaagccaaaacatggtttgataacttgactttcatttttgcccatcacggaataacgctgtcccttccctgagtctcccaccaggcaagcccagaggccacttgctcctttcaggcaagagacagaaggaggcccggtaccttcttgctactcaagggccatctgcttatcatcatttgttttctatcaaacaggccccaccaagtgtacatggtcggcggcaagagggaacgggagaatgctctcggaaactcctgatttttgtgaagaaccttgtgtgaccatttctcgatttcctcacttcattttcaagccctccttctcttgggaaagttgttttacattttagggcctgaatttctgggtttcttctctgcttcggtgtcagcagccttactgatgttccggtccacgcgtgtctgtctcagctccttccccttcgtgctcaggtgccctgcccgcgtgggaccacacaggtaatggacatggaatctgcagaaccacagagctcagagatcagcgtcctggaggagcctgaagatttccacatgccgtgaaaagccagcggatttgctgccactcaagtgtgggactgtgaggcaggagccacttctgggatagaaattagaggcttttggaagctgcaggatgacagggcagtcactcctactgggcatgcccctggctttacccagaggggctgatccaggaaagctcaataaattacctgagtcagttcagtgcattaacttctatagactgaatcatggagaaacatatgctaatcaaaataatacaatgcaaatcttctcacagtacacacagcaatttcctaatttatacaccctaagtcctgagttgtgtacattatctttttcataaacactactttaaatttccacctttagtatgctaagaacatagtacccaagcactcacagaggtcttctacaaagcaatttgtcatagttagtactggactagtattttagaaatttcaacaccttttcaaagccgctgattcttgttctgggatacacttggacaaacctgcaattcctaaatggagctctgtccctggacaccacaaggccgtgtgctgcttgcttctggaagtctccccacgtttcagactcacaagaggaaagtgtttctcaaactgatttacagcaactccccgatggaaatcatgtctggaatttttcgtcctaagtcactgtagtccctagacgagttacatgtaaaaagctgtaattttttcttaaccgttatgtagttgaaatgtcagttccattttgccttgagcttataatcactgtgagattagagcacacttttcaaaatcatcgagttgggaaatagtattgtttagggctgacctctcagctctgctcttgattatttacttccatttccccctaaccctgcggaataactgcgggtaaacaccgttcctgggtccagttatttccttatcgtgatgggcttccttcgtggcgcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggaggtaagcttgtctccaaaaccacgaggtggcgggatctttgccggggaatgggatttgcaaggtttgactggagtacgttagaaagaaaaacagagaatccagtcccctagggagcgtttacaagaaaattcatcacgtatttaatgggatctctccagctattcctcaatgaaaacagaaccgtagacaggagacaaataatattccaactgctttttcagtgactaaggaagtttctgtacacgccttttgacgggtgcatctagtcttgaaaagtctgtggaactggatttttctaaatggaatgattgtaggttttcacaggaaagctggctgtggagttctgtgtgatactgtgagtgtttttcaaagagcacgatgattattcacagttttatttttaacgacgtaacgtgattactggtaatcgaatttgcaacgtggtactttttttggttgtgcttttcagttatacaagcaaacaatctactaggtcaataaaaactgcccccgacccctggaaaaattgaccagacataaacgtcatgaagccagtggttcttaaatatccgtggtgagatccgggtgcggcgtggcaggctttccacagcatctggttcctccgctgttttctgaaagattcagatctcagccccaggaggagccagcattgggagatctcctccacatctgcatttcactgttactgctcttagcaggaataaacagaccctctcccaacacagcctcatttgtcctacagcagcccaaatccttgcccagggaagtaatttttctactgagtctaaaatcctttttcactctgcgatttatgccctcgcctgattcacaggtgtgattttatttgcttaggcatttttattgctaccagaccttgacctttttcagatgacaaggtttctgactgcccaattctctccccaaatcatgcctgagacctaatgttccttgatattacatgcttttattatcatcccgtattgactggctgtctgttgtcatctgtaagtccataaatcctcctttataaattaagtgcagtcagttctgcctgcacagcgactagaagaaatatttaaaatgcaggacagccaggaaggacctgtccatatgcaagtaattcttgattactcatttgaaaaggaaaatggctgaaaacctggacagttaacatttgctttaactggtctatttaataaattaacaataaacttagaaacacttaaaaagactcatattgctattagtaatcccttattactattaactgtgactgtttcattttatttccggtgcatttgagttctgcatggggcagagggaagtggatctccacctaattgagaagggctttgaggctttggactctggcttttattcagttggcagtggggaaccatgaaaggcttaagatctgtgagtgacatgagcaaaatgctgcattaggggcggaatctgtgcgtgggtgtgcagggaatgtaggaggcggggagcagagaatggcagcagggactctagagacaaaaaaaatgaattgatgagtgtcctctagctccaaaggctggcaatgagaagagatagggatgtaagtttaggtgggacgccattgttttcaaaacagctctcatggattccagggttgtgccttccagcaaccctgaaaacgaatgcagtttcggccccacaagcacctcccagtgccttctgtacaacagggctgggtataaaaacaggaacaggcccagtgcctcctgtacagtgggactgggtataaaaacaggaacagagcccagacccttcctcaaagtgcagacagtttataggatacagcagggcaagtttcattttcagacacctgttcataggaagctgaacattagctaactggaatttagttggtcagaaatcacacaggccacaaaggcagaaccagcactgacatccaggcttccaagacaagactgctgttctctgagtgacatcagctgcctctgacgtcagtaggacttgagatttcagaggagatttggcgagggactgtgcttagctagtgggctggggtgcagggttcccctaagatagtggcacagtgggtggggtcccgcctccatgtccaagtagtcttctggatggggaaattactaaattatgcattgctctgggaatgaactttttcccatatgtgatgagaacctgacttcgattggtccaaatctggttcatcatctatacttaaaaaaaaaaaaatgctcttcatgagtgaacgttagtggataatgctgcacgtgcagtttcccatctgcagctcggcttctgtagcagcaccatccttccctcacttgggtgtttgacattgggggttggtatacagagcccctcatgggtctcggagggcccagcagacacagtcgtaattcctgtcttcgtgtcttcttcatgtcttctgcctcggcactcctgggagcacccttatacagatgtggatggccctcccttgttcccttttaagcctggtgtggaaacacaggtggccccgtcctccctttgagggactcagccctccctctctggatgtctcggactcccgtgtgctcagtgggatggtaaatgcctctggggaatctccctggagcttgctgggattgggaaggtcatgtcatgcttttcttccagaccctgactccaaccctaaacctattcctgggccacgaggatgaacatctcaggcttgtgacagtctcggagacgccgggcaccacccacctgacccttctttgttcgagggacatgcttgagtcccaggataaattgggggctgataacagttactggccagagtgttaggacactatcccttggacgtggctggggtcaggcacgtggcaggcagcaggaagggtggtccatggcctgggggacatggctggcttggctggctgcacagccttgatgcctcagtgtagtcaaatgcacttatccctctgtgctattcaaggacctcccagccagccacgctgccgctgaacagaatgaagcgagcgtatgaattctgtcctgaatccacgttcccctctgtgacagtacattgctaggagatgacatcagaccaccagtctagaaagagctggggaggtgaagggaagacgggggcaatgcttgcctggctctggaggggaagatgcaatgaatgggacagaaagggatctgcctagaaggtggcacatgaggaagcagagtgacaagagggactgtgaatgcatcagggggacagtggtgggggcgcagtgagcgtgacgtttcacacacacgtgtatattcacacatctttctggatatgtgacccccagaaagagcccttcctgggagtccatccaggcctcactccatatttactactaatgtgccttcaagaagcacctgtgcccgttctgagcctgcagttttcatttgtgaaactgtggcatttacacctgtcctgactcaaagggcactgtgaagaggagatgagatactacgtgtgaaaaggctttcaaaacaaggagacatcacacacatgccagcactgtggctttgtctgtattcgtttttccactgtgatgaagagtgtctactagggtatttgaatgcttccataggggccattacactggaagagatctgggggtcatctccctactgacagtaacatcaaacagagacactcaagaattgatgtgagcacctgcagtttgtgcagagttgtgggaagggccctgaccccgagggtagggaagatatctggtgtgtcatcatccttggggacctgcagtctggccctggaggtgagactgtcattcatgaaataagagcaggaagtagaaaagaaatcagcctcactcatgcacggtcacccctcatctatccacagatcggggtactgggcgtgctttgaagagtcctcagtcagcacccagaggaacgggctatggacacgagggttgtgatccacgtggcggggacacctcagagtttgtggctatctgtgttgcttaggaatagtgtctggctgctagaaacagacccacagtgacaggagcttaaacaagatagagctgtgtttttacttttctcacatcagggggttgggcagtaggtggggcagtcatagcagcagctccgaggtcatcagagattcagggttctttgtctttttggctgccactttagcacgtgcctcaggtcacaagcctgctgctgcagtgccagccattgcgtccccactctagaaggcaacaaggagaaagcctcagggttgtgccttgggaacgagtatgcccacctttaaggaactttcttagaagttccatttgctgctgactctgcttacaattcctggaattctctccttgtggcagaggctggcaacgtggccttccagctgggcacatatctgtcccttgttaaggaaggaaggggaagctcacagcttctgcctcactttctaagtgagatgaaatctgacaatgggctcctggcttgcctcacacagaatgaaaactgcaaaagcacaggtccttcaggccatgacttcccacccatcccctgagggctcctcagcctcaggcccccagctccatggggctgtttgggcattaagtgctaaatgcttatttgctgctgggagccccacttaggggcttgaagtacccccagctattagcactgattgtcaaggcagcctaggggcttgagcaggtccttgaagctgaaaagggagtaattaaaacgcctgtaaactgaaagggaaagcataactcataaaattaattatttgtcggcataatttgggaaattattggaatgtctacaaagagaattcgacagcatgtcagagagcatgcagaaggcaggaaatgcccagccaggagaagaaggaagccctaggccagccagcctcatttctcctcctcccttcagtgagtggcagcttgaggtatccggggaaatgagatgtaattcatcttgactttaataaggcccttggattgagctcctcctgagaaagtatccgaatgcccgggaaagatggtgcagcgtgcgctaccattaggcgggtgtggaacttgctaggctgccgtctcaaagagaactcagcagtgacacagcatatgcctgggctgagggagggaagggcatgcaggctgccctggttggcacaagcagcaggcagggagcaatggagaagctgtctgctgcagggggaggtagcagctcattcttctagagcatacatttttggtctcaaatgtgtttccttccaggcaactccttaaggaagatcagcagtatgtagtgagcacagtgcgatgttgaccccaccactcactggccacactcctcgtttttcttttctttctttctttctttttttttttttttgagacagagtcttgctctgtctcccaggctggagtgcagtggcgcgatctcggctcactgcaagctccacctcctgggttcacgccgttctcctgcctcagcctcccaagtagctgggaccacaggcgcccgccaacatgccccgctaattttttttgtattttattagagacggggtttcgccgtgttacccaggatggtctcgatctcctgacctcgtgatccgcctgcctcggcctcccaaagtgctgggattacaggtgtgagccaacacgcccggcccttgtttttcttttcaatcccatttatggctcagatatatttacaatgcatggtttgtccactccagttcttcgcaagctctcggcatgggctagcaccttggacacatggggattacttaatataaactttctaactttcctgacttttcttatcccccttcatccaccatcccccattatcttgtcggccaatcccatttaatagattttattaacggtgactccatgaccttttcagctcaaggcattttaaaatgggacatattaacttacaaattgagcagcaaagctctaatacagtttcagccaagtgaactttctgaggggtgagaggaaaggttggtgctctcacagaagctgtggcctgaaactccaacagactcagttccgcatatcaaatttccatgatgattacccacgatgaaatggaaaataactgaaatttactcgagaattttaaatttaaataaccgaaatggactcagaaatcaatacgcttttggtgtcgagtggaaaaaattccgcggagtgtaagttgtgtataaccgagtgcccagtataattagaaacatttttcttactgccagtgtttacttcagcaactttctaatagtgtagcttgggagggagagtactatagtcatttgaagcaatcagtagttcatatcgatgctgactcgctgtttggctcacaaattcagtttttgttagaaattgttcaaataatgatgaaagacacaggaagaaagaatgtggctgtgaagttttcaggtgaacctgagtgtggaacactggacactgccaggatataaaatgtaatcgattacagttttgtcctaaaacaagcctgtatggattagcaaactccttctatacattttttgaattcatccattaagacgcagatgttggtttttctagaaggggtccagagacaaattatgctataaatcatcattctgagcacaccaagattttcctttttttctggttttatttctttatcatttttcttcttgtaacaggtatatttgtgctgtaatgatttattctggtttcagaacattaccttataatgaaagagaaatatttcatattttaaaagaaatggaaaaaacatttggttatccacatttctaaaacattagtaaaagctcctaaatgttcacttgggctttgaaaggttttctaaagtaaggattataaatgagcactctgtttgcaagccccattcttatctcctcttgggaaattctcaatgtggcattaaatgacattgcacaaaagatttgtttctcaagccctacaagactttctagacctcaggctgtacctgcagaataggataatgttccagattctcccagcgttgcctaaaacactaagtaaaaactgaacaaaatagatatggaatattccattaggggtgggcttcctttggtcttttagaacctacaggaagacaaaggacaggaagctcatgctttaggggaagccactgtgtaccagccttcaccatgctgtgccacgtccttacattcactgtcttactccattcatccctgggggtcacataagataagcatcatatccctattggacagaggcaaagatggaatctcagtgaggtaactcactttcccaaggtgatatagctggacaatgctgagaaatgccggagccgaaacttaagtctgctgggctcccaagcccaggctatcatctgccattactacagtttatgttttttgtttttgtttttgtttttcattctgtgtatatcagccctggtgaaaaatgacttccagattcccacagccgcattatgtggaatagaaaagacatgggcgtgcttctcactctgccgccgtagagggtgggtttgcagtggtttctgagcactttggactgcggtgcacaatgagaactctattttgcattcacacacacacacacacacacacacacacacacaaacagagcatccatggaacaatagtgactctcccagtgtatgtgtactttggtattttctgttctattccattctgtttcattctttaaaacaatgctgctgtgaccacggaattgatttccctatccacgagtgtatttgtgacctacagtttgaaaaatcctgaattccagcaatacagcaacactgtttggtttgactgattcttgcctccctttcggaaaaagcttccgccgaacagaggattcatcagggtctcggctatgaagcctgtcttatcctttcaactgtaaagacagacgggtctgagtgagggcgtgagcagggccgccagccgaggcacatagcggaggactggggtggagcagggcaggtagggtttagcatctgtatcggtgcagatcacctctgtgcacacagagaaggggttcctgggacttacccttcacctgccgctagaggacatgtggaaaaataaaccaatctaagttactgtgagcatcaccttattttgtgattcgcaggcctgtctttcctgctagcctaggaaccctgtgagggcaggggctgtgtctgatttgtctttttcatatctgtatccccatatccaagcacaatgcctgacctataagtaaacaaagcataaaatagatgtctgattgaaaacacagggcttattgttcctgtttcaacacccagtgctgcaccactttaatctccatcttcagcaccatagcctgccttctgccctgactcttgctgtctcgaagtctcggaagaaagcagtcctgagccctgtcacatgtgagttaggccttcctgtctttctgccttgtgatgtccaacagcaacccttcctgggtgccgcccacactgagcctggctttgctcaggagcctaaatgcagaatctttcctcctccccctcccctgctggaaatgctgaatccgggactgcagcccagaaggcgcatggggaaattaggtccacgaacgcgtccccagcgttggggaggtatgccactcagcaccctggacacgccaggccgcagcgctggtcttccacagtccccatgctgtatggaaaaggccccttgccccacggctggagaggggagctggtcgtgggaagagtggaagagaaaccacaaacatgcaattttcagatgcggagaatgcagagacagggcatgggaagtgggggtcgggagaggaagaggaagagacaccaagtcggcaggagcccaagcgagtggccagagcttccaccctcggtggccttgggcccatgttttagaagctcagcgtttggcatgggcgaagatatattttaggaatgaaactggtattttgtgaatagaaataacatcttgttcctaactgacttcagagtcagacgactggcttcacgagggcccggtgtgcagacagcctgccagggcctgcgggctctccccacgtgctgtgcccccaccccagcccaaacactggccccaaatgcttctcttcaatgcctggcaagtaaagatttggaaaaaaaaataagttcagaaaggaacacacaaaactttttaagtgttaaagtattttcttctgaaggccatcagaaaagaaacttgagcttatttgtcaaaggtttgttaacctaataatgccgtagaaatgtttaatgcagtgagaaccttcaggtctatcaaaactgcaagcaccataacaacgcgagaactcagccgtggcccataacaatctggaattaacgataacacccggcacacaaacggcaatatgtacacccacccagcggtgtgcggccggtgactctaccaggtaacgaactcaccgctccctggtttcaaaggcgtatacatttaattctatgtggtaacctggagaaatggacacctgtgaatccctgctgtgttctggatagatgcatcagtcccttatagtttaaaccatgtacatttgggatcatgaaaaacggtgtgtgctgttgtgcaggacgtgaagatttgtgcttcttgcatcgtggggtagaagcagctcccccactggctgctcggctcccagcccctggcttgctagaggagatcggagccagcaagtggtccctgaatggtccagtgaaggctgccgagcacccaggagaactgatactgcacctgagggtcatggacgatgaaatttcactgtgtagagaaactgagatttcacggtttatgtgtaacagggaaggtggtgttgctttagtaaatagaactgggcatgttagaatatcggcaagtgcactctaatttcctcctgtgccaaatccagctgattttacagcattctcagtgggctccttagcatgtgtaggtggggtttgcacagtcccgtagggatactaagtaggatgtagaaattgctcattccttactgcagaggcctggatattcacatccacctggcccaggagggcctatgaattgctctcccagcacctcctaatatcagtttattaattttatttgacatgttgcaaatctccaaaacatcctagagctccatgcttagcatgagtttcctcggattaaccatcattttctactatttctccgtttatgtagatggaagagaagatgaatagtaataatcttttctcaggggtgttgcaaataagctttatattaatttcatcacattatatgacttaaatatcaaaaataaaaatgtgtgtctctctcttcagcagcagggaaaatacctgctggacgtagtcacagactctgtgggctttaactggcagcaaacggtcctggtagaggagaggagaagggggagaaggggcttgtgggaacgagagtaggggctttctatcaaccaattaattaggatctagatagaataaaagcaacaagcaggggaagaatggaggaggggagggagagagggaagaaagaaaggagcagagaggaaggtaggcaattaggtaagaaggggaggaggaaggaagggaggagaaaataagtagaaaagcaaattgacagtggtggttctcagagatggtctgtggacccacagaatcaacatctcctaggaacttgttagaaatacaaattctcgggccttactccagacccactgaatcagaaactcttaccatatgtgtttcgacatgccctccaggtgactctaacacccactctaatttaggaaccttctttaggcattgataggtagaagaatgtaataccaaggactaataaccatgagccccaccagctgtcatagcagagggcttgtacccacggaggatcagtccaggctcctggagagaaacaataagcaacagtccccgtgaaccacagcatgtgacatgtgacatcaccacgtgtgcaggcaaatctctcagaagaaacctcaactgtgtctcaggaaactctggtggttgggtgggaggctggagtctccttaaaataaaggtcatgactttgggaaaaaggtggatatgggtgatgacacattgtctacataagaggactgagctgttgggaccaaggtgaaccagtgaaaacacacgtttggaggaggctagaatttcataacactttatgtcccacatttccacctctagctctctggaggacaggctgggaaggtctcattggccacactgacttccagtcaagtatcccttttcttctggttttgatcggctccctgtcaagatgaatgagatttttgttaaacacgggattttgttgtgacttgggatggggttcatctcaaaaaggagaggaagagcccattcagcggaaaacccattggaagatgaggagtggagaggaaatacttggacggagctctgcaacacttgatggggacaggactccaggttcatgtaaaaggaagacgccaagagaagcacaaccctgtaattcctgtaattcccaggaagccatcaccaggggtcacgtcgggtgtgctcaaagtgcggcacattctaccaaccccgtttgcttttccgaggggggtgggggtcactgaattgatagaccttttccgaggtgggtgggggtcactgaattgatagaccttttccgaggggggtgggggtcactgaattgatagacctaaataccatattcatcctgtagcttgattttctttcttttattctttctttttttttttttttgtgaagaagtctcactctgtcatccaggctggagtgcagtggcacaatctcagctcactgcatcatccacttcttgggtaaagcaattcttgtgcctcagcctcctgagtagctgggattatgggcacgtgccaccacacctggctaatttttgtatttttagtggagacaggatttcaccatgttgggcaggctggtcttgaacttttgacctcaagtaatctgcccacctgggcctccgaaagtgctgagattacaggtgttagccactatgccctgccgattttctttcattcactcattcattcattcattcattcattcagtaagcactttgtagataagatgagaaatatggattgggtaataggtcattagatggactcccactcacatcacccaagcagggtggggattgagctatgcccaaagagtgtgatttacttgatcagccaccacttggagggtgacctcaacaaactctagcatgctgggcttctcctgggcagtaccgtctgtgacttggagcaaatggagatggcatccctgtcaaatatgcaggtgtcacagctaagggggtaattcatcgattctgccccagaatcagaaatcaaaaataaattgctttgttagattggtggttggaatcaacacactgaaatgtagaaaggataagccaacatgctgcactcggatacaacaaccactaacgtggcagcaggatggggagacgtgacttgtcaccagttataacacttggggtttacacccagagagagctgtgaccgtaacttaaactctctgtggatgacaggtttccagatcgaggtaaatggcagcaccatacaaccctgtactggctagatgcgcgtcaagcatcggctccgggtgcctggccaccaggggaagcaggaaaattcaggcccctctgaggagcagagccagaggggcagtgcttcatctgtctcatcgtgtgagccacacagagagaaccaaggcatgtgttcctcctatcatagtcaagtccagttagatatctttgtgacattcaaatagtgtgacagctatatatgtgtacgaaaacagcttacgcagaagacagaggggaaccaatgggcagaagttgctcaaagaaagatttcagttcagcataagggaaatcctccttatgatgtacaccctgcacgagttgacgtaaggagcaggaaggttgggtccaagaagttttgctggtggcagttgacaggtcgcaggcttgggtgaggtgacaggactcctgcccagcaagttggcacatgccgtgacctaggagggcccctggggcaccttctcctccagtctgcataactctatctggacatcatcaacgggcttttcatacgcgccttggtgctatgaagcttcacacaagaagcgttcggcaccaacattcaggtgattttaatttcatataacaaaaccatgatgctgaatggagcgtatgtattccagcttgcgtccatgccttggcatgttcccaggttgcactagccttcccgctgtgtttcatctggcaattatcacttatatttaaagctttggcccaggaactgtctcctccgtagggcctcctttaaagaattccatgctgacctgcactgtagcactattacacagaagtgtaaatgtctgcttcccctactacactatgagctccattaaggcagagacatcgaacttagatttgttacataaacacaaagaaaggaccaggtttcataacagtaggcccccatacatacacattcacatacatgcgcaaacagagacaagtatacatatacatgtatacatacacatctgcatctatatatacacatgcacacacatgcatgtggacacgtatatatacatggacacagataagtctatatacacatatttaagtatacatagatatgttcttgtacatgtatatatacacgtacatctgtacatcctcacacatacacatatgcatgcagttatcagataaaatcggcttctgtgtaattgaaaatctaaagccaaaataattatttcagcaaattataatatttataaattgaacttgtatattttgccatattattagtctgtaatcttttatcacagaatttttagggaggaaaggaaaagtttactagccaatggtaatgttactcataacagagaatcaatagattgtatccagagaaagagaggactaaggttctatgtaaacgtctgaattatgtgtgtataaacattagagcaaaagtacaaaaaccttcccgattactaaaacatatcaaaaaagagagaaaacagaccaaataaagacacacacacttacatatgtcaagaagtgtacatgtaattatatgtatgtagagaaatatatgtagatatagcaactatctacatataaatatatgtagatatagcaaatatatgtagctatatgacagaagtgaagtgaaatttattgattatatcaataaatatactggacttaattagctttataaaaataaataacatttccccagcactttgggaggccgaggtgggtggatcacctgaggtcaagagttctagaccagcctggccaacatggtgaaactctgtctctactgaaaatacaaaaattagccgggcatggtggtgcacgcctataatcccagctactcaggaggctgagtcaggagaatcgcttgaacctgagaggcagaggttgcagtgagttgagatagcgccactgcactccagcctgggtgacagagtgagactctgcctcaaaaaaaaaaaaaaaaaagtacatagatagatagatcgatcgatcgatcatgtcctaggccacagaaaacccaaacaggtccaaagaatgcagacaaatgcaccagataagaaagttgcggattagttttatcttaagagtgttgatgggaaaagctaaaatggtaaaaattatcaaaatccaacagtacatttaaaacagtagatcatattcaagtgggatttattccaagaatgcagttttgatatttgccaatattcaatgcccatctggagtacaagcatatgataaaatagaaatgtattgacatttatttgatacggtaaactgtgcatgtacctcaagctctcaaatctgcattccccatctacttgactgggaaaccctacaggcattcctgctgaaggcagaagcgtaaggtagtccacagtctcctctgctctttaatattgaaatcgacacatttgccacagctgtagacaagagaaagcaaggcgaggtataaatccccaaaaggaagtgattaaactatctttatttgcagataataatatatgatatctggaaactactatgagcaataaagaatttagcaaactagcaagctataaaatcagcatgaaaaaacaaaccgacttcatatgcacaagcaaaacatagcttgaagttgtaatcagagagaagatcccatttacaataacagaataacattagaaaagaaaagaaagctggggataaacttaagaaatagcaaacacatacgaagaaaagtacaaatgctgctggaagttactagagaaggtgtaaacaaacggaccgtgtttttgaacaggaagactcaacatcacagggaagttagtgctccttgtgtgaatttagaattgtcacatgatccccaataaaataataacagatttttttctggagctagaaaagttaatttaaaattcattcataaaaataaatgagcaaaaatagtcaggaaacttctgaaataaaagtaatgagggtggactagtctcctttaggtattaaaacatattgtaaagtgctgtaactaaaatggtgtgtctattggtggatgactagaagatgtccggaacagaacagaaagcccagaaatggaccccattcgatatggcaatttagtatataataaaaggacatcttgaataactgaataaaatagactttttgataagcattattgaaataagtggatacctatatggaaaaaatacaaaactgtatccattccctacccccatatacaaggatacattccaagtggatcggagatatcaatattaaaaatatgaaactgtacaagtactagaataaaacactagttttagtctctctaacctggaagtggggaaaacttgtctaacaatgactcaaaatctcgaagcaataatgaaaagattgatgaactgactatttagaagctttaaaaagctaaaatattccatatgcaaaaaaatacaatgagcaaaggaaaacaagacaaatagcaaattgggggaaatctttgcagtttatatcccagagaaatggttaatatctctatattaagagctctaaaacagagaagaagaagaaaattagaagaaaaatgggcaagctctatgaaacaagagttcacagaagtgcaaatggcccataaccacaggagaatacgctcaaccttatcaaggtaacacataaaaagtgatggtacacagacacacagagaacaatgtgataaaaatgcaaaagtctgacaatactctgatgaggctcgggggagggggaagaggcattgctgctaggaatgcaatgatacaacccctaattaattcaatccaaacacatcagtgggtgctagaactagtgggagaagtttgatgaggaacaggatagactcctcacaaagtatgtatacatcacaaaggaaaaaaaacggagtaactcgaccctggagaaacctggcagtgagtggttgcagttagcaccaccagtaatggggcacctcagaactgtgtaccactggataggatgcgatgaaaagaacacagcctcgcctctgtgctattcgtgcctacgatgcaagcctgaatcaagttaaaaagaaacatcagatggactcaaactaggaacatattgcacaagaaattggacggcagcctccaaaagtgacaaggtcatgaaagtcaagaactactccagattgaagaagacgaaagagacatgattcctaaatgcagcatacgatcaaaattggattctgtcaccacagaagacgttgtgggaaaacaggagaaaccgtagattagatggcagtcatgtgtcaatgccgacgtcccggttttgatgccaatattgtggttacctggtgagtgttcttggaagtacatactccagtatttgggggtgatgggcctcatgttagcagctcactctcaaacagtttttaatgtctttatacaatttgaaattctttgtaaatttgaaatatttcaaaatgaaaattatctttggcgtttaaaaatgtttctcattctttttcatttaaaacacaaactgatgcagcccctgaagcaggacaagttagcagtaactaattaacctgtttaccttctcactcacaaactcgacttttaggagtttattccaaaaatgaacttgcagacaaatgaaaagatacaggtacaagcctattcgctgcaacaccacttgttatagcaaaagactggaatctaccaaaatgcccatcattaagagaccgactgagtagaccatggtatatccacaagatggcatattatatatcataacagaaagaggacgaattcgagaactagagctatggggaaaaagaaggtaccaaaatagaaatcagcattctctgaatatatttgcttatagaattggctttgaaagcatgtaaatatattttatctattcatagcactaaattaattttttttggagacggagtcttgctctgttgcccaggctggagtgcagtggcacagtcttggctcaccgcaacttccacctcccgggttcaagcaattctcctgccttagcctcccgagtagctgggattacaagcacgtaccaccatgcccagctatttttttttttcttatctttagtagagatggggtttcaccatgttggtgaggctggtcttgaactcctgacctcaagcaatccatccaccttggcctctcaaagtgctgggattacaggtgtgtgccaccatgcccagccagcactaaattaatttttaagcctttggaaaagaaattctaagaaattgaaggcaaaattaagcaaagggacagaattgtatactgagttggtggcataacagtatggaaagtaactgtttcacataactttgaaagatggaaatttgtacatcctagtgggatgtactctaaggacaaagaaaaaaagattttcaactgttttcagccattggaatgttggtgggagtggcatggcagatttgtgtctttaagacagttgcatgagtattgtggggctaaagcaactaagtgattatgttgatgtctttgggaaatgagattttcagcccagtcttaactttaagtctgaattgggactataatgattttaccttttaaaacttaacctagtggcactgagcttcctagtaacagaaaaatagcaagtttcttggataaacacatgattgcaggtcagaagcagataatgtgtaagatgagcctggaacatctcatcattccaagaagcaaagacggtatgctatcaactatcaacatggccttgtcaaaaaaactcttaggccaacttgaagaggctcctgctagttaaagatgggaaaatttacaaatccataataataataataactgcaatggactgaaatgcttcaagtacatttcaatccgtaactattcaatgctgaatttgtatgaaacttccaagtcaaaaatctcttttaagatttttagtaagaaacttgagcttcatcggtgaacataacattttctacaccggattttattcttgtgatgacttcattcaagacttttaatgataacctcttcaaatatttgaaagccgcaattgacaagaaagcttctgccaaagtaggaggtcacaattgctgggaaattatttattgctttttccttagttgagagcaacttttttcttgacattaactagaattcagataattaagtctctttaaattatactataagggtacagtgtttctttaggtcgacagttcttctttttatttctttgacaaaagtaatgaatggttttgtgatcgtgtaaatggatttggaatctgatcaaatgtttttaatatcaggtatttcaaaataatgggcatttctgtagacctacatggatgccgctctaccagtcttcattatttttctttagggcataaacactgacttctttaggattacaaaactgattacatctcacagtttttaacaccgtaacatagttgaaattttgctttgaatccatacattttacacgtacacgttagtatatgccatggtctaaatattagtgtccctccaaaatgtgtgtgaaaattgtaacccccaggagatggtgttaggagatggtgcctttgaggggattagattgtgagggctggttgggattagcacccttatgaaagagacctctgagagctagctagtcccttctgtcatatgagattacagttagaaggcaccatctctaagaaaacaggccctcaccagacactgaatctgcctcagtcttggccatcccagcttgcagaactgtgagaaataaatgtttgttgtttatgtgctacacagtctatgatatttttgttatagcagcctgaactaagttggtatacttttcacaggttcttgcagctgtctattgcattcactcaggtgcccaaagacgtcatttaagaggccgtttttgataccaatatcctctgctttaaccaatcttcaaagtgagaccccttcaccaaaagtaataacaatgatgatgataacgatgcattgttcatagattcttgcaaaactctttggacagccaatgcttgtcaatttgaaattgcaataggaaatttaaacgtttctgcttttgaataatattgtttgaagatgcatggatgacaggtcagatgaccaaagacgaacttcatctagaagatcattaaatcgaacaagcttcgactgcacactgggagaactgatgttagtaacaacacttgatgtgtagcgtgagtctgaatctctcaaaagaaattcttgggctaggcatggtggctcattacctgtaatcccaatactttgggaggatgaggtggggggatcagtggaagccaggggcttgagaccagcttgggccgcatagtgagacccatctctacaaaaaatgcaaaaaattagctgattgtgatgactcatctgtaattgcagctactcgggaggctgagttgggaggatcgcctgagcctgggaggttgaggttgctgcagtgggccatgattgaaacattgcatcccagcttgggcgacagtgcaagaccacatctcaaaaataaaaataaaatagcttcttttgtcaaaaatgacattctgattccatatttttcacaaagcaaaaagcaagtgggaccatagcatcttggattttattagacgtgccattctgataacatcacttaatgaggaatacagctttataggccatcttttacctagagaccttctctgcgaatacaacaatggatttcttgattcccaggctcttcagattgaattttgctataaagtgtttatacctttttaccatcattggtatccaaaacttataatttttttctctattatgtattccaaagtgtttgtgtaagctttgaccatttcatccccagcagtttgtctggtatatggtagatactgtagtgctgccacccaggtcggttcttcagggtgacacagctgtccccagtgctggcacataggctgcccagctcacagctgtgaccttcactgagaactgcctgaccaaggtgacacccctcccatgggtcatcctgtggctaacggcgccacaggaaagcccagtcccctttgaatcagttgaggacaacttaagacccctctattccagagctccccagaggatcgactgaggcctcagctactgccatcctgtgggacagcttctccttctgccctgtcctggcctccccacttcctggcagatgtctctgttgagttccactgaaacttaaactccaaactcttcacgcccagagtctatgaccggggcaaacaattgaagacagggaatttttttttttgtaccttaaatagtgttcaaagcatttattttgagggattcaaactcatgccatacaccaagtgccgttactaacatcagcacttatcaatctgcagtggaagcttgtttgatgtaataatcctctagactgggtttctctgggtcatttgacctgtcatccatgcatcttctaatggtattattcgaaagcggtacttttcttatttcctgtgcttcactggtcccaaacatgttgctgacagtttctaatgcaccttggcaaagtgagtgattctgcaattgcaggaggaattttggctttggctgttaaatgcaggacattggaactagcatcttgtattcagtctgacacagttgtggtccactcatcaatactcccacttcttattgtgtaactgcagacaattttcccagttctgatctttttctgtatgagatcaatgctttagggaaaggtgctggcataatttgcctgatgtcattgcatcttctgattcctttttcattaaatacgacattgagacagaagaagacaggattattggaaaatgcaaatctgaatttgagatcattttcattataatttcctgagtagcaactttttttaccactctacttggtacacttgatgactttctttaattaaaaaacgtaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttaatgggttcagcacaccaacatggcacatgtatacatatgtaactaaccagcacgttgtgcacatgtaccggaaaacttaaagtataataaaaaaaaaagtttcttattatgatgggaaaatatctctctataaatatgcaacagtattaaaaatatcaacctaagtaattttactaaatatatacatatttaaatataaaagtatataaagtggcctgtaggccttaatggcttcaaaaattaacttttcaagatattttgattgcatacatcctcaagaatgtttcaaaataaatcaagttgaaaaattcaaaaagcaaagcttgcattaaccaaaatgagcaatattgacattcctttttatttgattggacaattaaagttctgaaaaactcatgaatataaatgtcagtgatgtcatctctgatccaaaatattttgaaaactcaattatttgaagatataaaaccctacagtcctctttactgagttgatttaattatggaacttattataacatctttaaaaatctgtaaaaacagtaatttattttgagattccatcagtaatcagatcttgctaaatttacatcatcactagccagaaacgaagggaagggggtgggggagaagaaaattttaaaaatcatttttgttttaataaggaacacctaataccagataataattataaacataatcatacgttttacttagtcacataggtaaaaatactagcaaattaattgaataagaagcgcccccacatgctgagcatgttactgaaccaaactgggtttgtctgtccctgcatgagaggaagacgctgaagcactgggtttttgcagcaaaaaagctttattgaatgtcaagtggtgaggagcaggaggaaagactcaaatctgtctcaccacactgggggctgtaccgggctttataagcatagggtaatgaggcgtgttctgattggatcttgcagtggggtaacgccagagctgaatctgattggatcctgcttcagctttgccatgtccatttcttaatccagtccctgctcctctgcctgagcacttaggttcccccaccgtggttgcatgcttggttcatctgagtgtgctcagagtctgtagtcttcaacccgggggtccgtggcaactgaaaaacaactcacaacctacttacacacaagtcgaaccacattgtgaagcggcatttttgtctagggtaatacccaaagtttgttgtctcacgctgacgaaatcaaggacccggacacacaaggagtgaggttaagagtggaggtttaataggcgaaagagagaagagctctctcctgcagaggggtccggagtgggtttttccagtccgccacaaaatgcaaaggattttacagatgagctggaggaggcaatgtctgatttacatagggcatgaaagattggtcagaccaggtgtgccatttgcataaggcacaaaaaaccaggactggatgcgccatttgcatagcctccaaaaatctggccacccacaccctaatcttttattatgcggatgggttatctcccccgctggtgccttgttgcctgcatttttactgtacacgtggtgacaaagaaaacggaagatggagcctccatgttgaatgtgtctggccctcaggtagcccttttctgttggcacagctgccggcattcacctgtgcaagtttctagcttgcttatctatgtctgcagctcagtttttcaggctgctctttgttagaaaagaaatgatttgggagctgttttctgttaaaagggaagccttgccaaagactctcttaccctcactatctgcctaaataatttctttctagctcctgtatcaattggtcctgtgcctggtacagacaaacaaattcacagatgagaaacaacctgcaagtgaaataaaacagcttgataagaggggtccatgggggtgtcagggaagtgccgtgtggctcagccaacctgtgcctttctgcagcagatcctctcaagagagttaccgggttcagaaagtttacaggaaccacatgcatagttttgttttacttttttttttttttggagtactttcagattcataggacagttgagtagaaagttaaaagagttttgatatactctctgcccaacatgtacaaagcctctcccactatcagcatcccccaccagagtggtacctttcttatgagcagtgaacctaccttgatacatcactacccaaaatccatagtttacgtgagggttcacgcttggcactgtgcattctgtgggctttgagaagcatatggtgacatgtatcccccgttatagcctacagaagagtttccttgccctcaaaacccccatgctcctcctgttcacccctcctgactgccgacccccagcagccactggtccttttgctgtctccatagtttgaccttttccaaaatgtcatatgtagttggaatcacacaacacatggcttttccagaatgacatctttcactgaggaatgtttaatgcatgcgtgtcgtgaaaacacagcatatatatagtgaaaacagcatgaaatgtaacttcaacagctgcaattttttttttcttttttgtgacggagtctcgctcccttgccaggctggagtgcagtggtgagatctcggctcactgcaacctccgcctcccaggttcgagcaatactcctgcctcatcctcctgagtagctgggactacaggcccgcgccaccacgcccagctaatttttgtgtttttagtagaggtggggtttcatcatgttggcccggatggtctctatctcttgacctcgtgatccacccaccttggcctcccaaagtgctgggattacaggcatgaaccaccgtgcccggccaacagttgcaaatgtttgaatggctgtaaacggtggtttatggctacaaaaactaacagatatccctgtctctgggtccctgtgtaacctatccgaggcacagtgagagaccactgcactgtcccacctccttcttccccatccactcccagaaatcctctcttcaggtaggagaaactgctactctctgatccaggtttcacatatttccgtgggatataaaacccctagtgcctgaaactgctcttctggtttctcctttcacctgtgattattccctgagtgtcgggggcttcaggacagaagactttgtcattggctgtgagcatcaagacagtgtccaatgggtttaggctgagagccagctcagccaggtgcctgcgtggggggaattatccagtgaaaagatatttgtctgctcagtgaaaaccagaaaggagcataacacctgtcacgttaccagcctgcctccaggcctgccattggaggcacagcaagggtctaatgctaatcatccggggaggaagtgtcccttgaggcttagtctgagcagcgggaggccacgctgcacacttgaaaccccttttgccttgacttttctgcagcatagttggactaagcccttgtcgttggcttaagaaggggcagggttatgtaaccctcaataattaagacctttccagccataaccactcttttattttcaacactgtcaagaaggatttgccggctgtaactctttctcgcttgagggcatttttaattccattgtccacaaatttctgagtcatttctgatggcggtaatcaggacaaagagaagccgaagacctgggaataaaagcaaggttggcgattttttgaattaaacctagggtattgagagaaaggaaactgaggctttagaacctcccttgtcctgtgactggggaaggagagtgtgtgcccacaggtcaggctccgaatctgacaccagggagcccaggtagagtgagtgtcacagccaggggctcaggtagagtgagtgtcacagccagagacccaggtagagtgagtatcatagccaggagctcaagtagagtgagtgtcacagccaggggcccaggtagagtgagtgtcacagccaggggctcaggtagagtgagtgtcacagccaggggcccaggtagagtgagtgtcacagccaggggcccaggtagagtgagtcacagccgggggcccaggtagagtgagtgtcacagccagggacccaggcagagtgagtgtcacagccagggactcaggcagagtgagtgtcacagccaggggctcaggtagagtgagtgtcacagccagggcctcaggtagaatgagtgtcacagccaggggctcaggtagagtgagtgtgagagctcgtgattttaggtagcccacataatgagaagggaggggaaaatgccttgttaaatgggtgaactcaggaatttgtttctctgtaaacatggtgtgccccagagaggcactgcctccaggatgcaggaccagaacttgacgtgaggattgtgctgcagccacgcaaaggtacagacgtcctcttgaatctgcaggaaatgactacttatttaaattatgcaaatttttttgttgcatatgatcctcatagccttactttagagaatttaacaacatttgatatttggtattctggcattcctgagtcagtaattgggcttcgtgaaaccccagagctaaacctaccgagaatgagatgccgtcctcaaccccagaggttgtgggttctaagagaaaacgtcacaacaaatgttggtcttttcccaatagctcctggcgtttattctttcttttcccttttcttcctttttctccttcctcctcttgtgttttcttttctttctttcagcagagattgttctggtcatctattgctgcctaactgactaccccaaaacttagagattaaaagcaacacctgtttatatgtcatgattttgcgggtcaggagttggagcagggcttggatatgtgaccgtctgtgcctctcattcagttgggaagatggcttcgtgcacacgttggcgccatggctaggaaagcggaaaggctggctccctgggctgtccactgggcagctgcccctggcctcgccagcctgcagcctcaggatccccacactcctaccgctgctcagggctcccggaaggcagcagaagctgctagtttattaggacctggatcatactctattggtcaagcagtctcagagcctacattgaagggtttcagacatagacaccacctcttcatgggaaaagtatcaaagaatatgcagcattttgctttgctttatttttttttagggacagggccttactctgttgcttggagtgcagtggcaggagcatagctcacggtaacctcaaactcctgggctcaaaccatcctcccacctcagcctcccaagtagctaggactacaggtgcatgccaccatgcctggctactttttttacttttgtagagacagattatctcaccctgttgcccaggctggtctcaaactcctgggctcaagcgatcctcccaccccagactcccaaagtgttgggattacaggcatcagtcaccatgccctgcctgcagcatgtttgaaaagtgagatttattgtggtttcataatttacatacagtaaaactcaccctttctagagtacagttatatatacattttcacaaacatctttagcccacattcaccagcgtgacggagatatgactatttctgtcacctcccccaaaagtctttgtgcttttatattcacccctttacccccaccccagcacttggcaagcactgctgttttttcttcttatatctttgcctatttcagaacatcatataaatggagcatgcagtgtgcagtcttcagaacctggcttccttcccttagtgtcatgcatttgagattcacctgtgcgttcatgcgtataagtattttgttcccttctactactgagcagcatcccattccatagacacactacagtttgtttcccatccattggtttaaaaacatttaggatgtttgcagtttggggtgattattaaagctgctatgaatatcacatatagattttatttatttatttatttagagacagggtctcactctgtgcccaggctggagtgcagtggtgtaatcacagctcactgcagcctcaacctcctgagctctagtgatccccccatctcagcctcccaagtagctgggactataggtgtgtgccatcatgcccagctacttttttgatttttttttgtagggacggggtctctctgtgttacccagactggtttcaacctcctgggctcaagcgatcctcccacctcggcctcccaaaatgctgggattacaagtgtgagccactatgccccgcttcatgtagatttttatgtgaacttttacatgtcttgtgcacagttacccgggggcaggattaccgggtcacgtggctcgcgcatgtttaacttcgtaagaaagcaccaaacggtcccaccaggtggccgtgccatgggcatccgcatctcaaactgcgagggccttgggcactccacatcttcacggacatgggttgttattgctgttggtttgtgatgtttgagtccttctaataggggtccagggcatcccatcatggtaaatgggatggtgaggttctcttcactcatggatttcctgtcgttctattggctttggtgaagtaactattctttttgcgtacatttttggttttcttacagttgaattttgaaaattcttttttctgcatagtaggtttttgttctttttttttgtttttttctttttaagagacaaagtcttacttggttgctcacggcagcctcacactcctggggtcaagggatcctcctgcctcagcctcccgagtagcagggactacaggcatgcactaccacacccagctgatttttttttttaattttgtaattctttgtagcggtggggtctcactatgttgcccaggctggcctcaaagtcctggcctcaagcgatcctcctacctcaacctcccaaagttctggcattccagccgtgagccatgagccacagcacccggcctggataaacgttctttattgggtatctgtcttgcacacgttgtctcccagtctgtggcctgtcttttcatgaagtcagctttattcattttttttcttttatggattatgtccttgatattctatctgagaaatttttccctaacccagtgtcataactgttttttcctagaagtattaataattataggtttacatttatgcctctgatccattttgagttaggttttataaatggtaagaaatatagatctagattttgtcttattttgtgaatgaatgtctaatatttccagcaccatttgtcgaaattactatcttttctttgtgcttttattgaaaaccagtgatatatgtgtgagtaatttcttgcctgtcttctctgatcagtgtgtccagcccttctccagtaacacccgttttaattactgttgatttccagttagtcttgaaatcatacagtaaaggttatccaaatttttttcagacttgctttggctattctagttaccttgcttttccatatagattttagaatcaccttttcaatgtctaggagatatctagctgtgattttttttttttcttttttgagagcgggtcttgctctgtaacccaggctggagtgcagtgtagctgggatttagattggggttttattcactatattgattggtttggggagaattgacctctttactgtgttttcttccaatgcacccatgtgatatgattctgtattgacttaggtgtttggtttccttcattcgtgttttgtagttttccgtgcacagctattgcacgtagtttgttaaacttgtatctattttatgtttttagagcttaaatgagatattagctgtaggcgttttataggtgccctttttaaaatttagaatgttcctttaaattcctactttgctgagagggttttttcttttttaaaaaatcacaattgattattaaattttgccgaatgcttttcctaaatctattaagatgttcatatgtttttctattttattctgttgatgtgatgaattactttgattgttattcacatcttgagccagccttccatgtataagatacacctcgcttgatcaggctagactatgactgttatatattgttgaattttattttctaatattttgttgaggatttttttgaatttgtgttcatgatggatattggtctatagttttccttcagaggctttttctgattttggtatcagggtaatgctttagaattggtttaatttattcctcaaatgcttggtggaattcatccatgaaatatgcgtagttcttacctttgttcctctggatgctgtgtgtctgcgctcccaaagcttctgtcctctcttgtagctcacattcagccttcggccattcattgaggattttgggtgaatttcagaatttccattgtctcctcctcccgcgctctgtgacgggtgagcaggacccatcctgactccttggacaggcccatctttccttgtgtttccgaccacctggctggtatgcaacctaagctgtcttatgggctcaggaaaagtgattgttttgtactttgttcaacttttcttgttcttaggtggatgtgatgttctttccaatgctcggcatcccaggcacagcaagccctgtgtccatttttaacccacacattttacaggatggcaagtagggcagtttcctggtgacttagagagggggccgaggggcatcacagccatgaccagcagtggatggggacagagggtcctcctgcatgcctgggaagagaagacttgaggggcttggccaagtttatgtttgtctcatctctgcctgagacgggcttttggggaagggagccgagaagagtgtagcgattttcaccaggaccacatgggatcccgtgtgttccggccgagaagacccttgtttttctttctctgcgtggatccacaggatcttaggcttctgtgcctcactttagaacaagcacctgaagaaccaggaccttccttccacccagtggaagccttgatggtgcagccggaggcttggctcctctctgcaggccactggggttcccatcctgaagaagctagccctgcccactgccctttccggaaggccttcagttccccattgccttatgtatgcgtcatcagccgtgctgctgggcacggtagacaatcccagcgagacccgcgcactgtcagcaccccgcttccccccacccctcgtccagccgtgctccgtgtgcacccatcctcgccaggctccttggcaacattttgccttttcccatggctctcccagctgagagtgcccttctcaagaacttacccctcacaggccacccttcctcccaaacacagtccagatgaggccctccagccctcccaggccagaggcagtcatctgcccttcacgagtttgctgctctgcagagcatctgcctcttacagttacacgagcatgtcccctagaaagggcatgccctgaaggcagtcatttggcaggtatataattgggttcaatagctgttctgtaaaagagagaaacaaactgtggaaaatccaaaaatgattgtccccgttgacagacaaagagaaatttaacctccaacagcatatatgggacaagggtgatgattttgtttgcttgttccccaccccccgcctcaatgtaatgaacaatttagcttgaaacatagtggtatatattgagggaggatttctagatgaaaccttgccttgatctcaaatatctgttcattgaaaaagagattagagaaagctttgcttgccgtccgtcttggaaccacaggaaaggcccatctgtggaatgagaggatggtctggtccacctttctgcctatgccttaaagaattctgcaagagaaaatgaaaaatagcccaattctctttcttggtaatgccactgtaagcttcccaaaacattcatcacacttcctcggtctcagtgcaataattgcctgtgagcatgatggcagctaagggtttcctttctgtctctccaccccatggtccctcctgccatttgttctgctgtcatcaatgactgccctgccacagtgcccaccgcgcccccgcagaacgtgcagacggaagccgtgaactccaccaccattcagttcctgtggaaccctccgcctcagcagtttatcaatggcatcaaccagggatacaaggtacgtggcctgggttcagggcctgtgggcagctgtcattgtctggagccacagcgcgacgcagctggaggcaccccctcttgtgtatcaagagctggttgcattaagatacagggcgtcttgaccttggtgagaccaccatttatccaaagtcttggcatcagctctgcaggttcagaaattcaaattcctagttatcaagaggatggttcatacatcagtgagcaatttcttatgagaaaggccattcatttttaaatggtgggtgggagacgtgtctcagtgattagaatgaatatttgcacaaactacttcttcccagaaggaggtcctctcaggagaacacaggccccgagcaaagggaatggtgtgagtgatatttccatggagaaaggatagttttctctcctccctttctacttcagggagagttctgtttaaagaactgagaccagttgattccagctacccgcccatactgaattagacacatagacaaatttccatcatccgacttcttgtgtctttagctaccagagtgtgttaacttcactgatgtaccaggatacaccatcacaaagcacagctgatcctccctttcagatcagcttctcctgattggatttgggagcgcaccttgattttagctacaataggtccactaatcgtctttaatagacgatggacaggggaagctctatacagtgaagggattccatctagtttcctcaatacctggtaatttcacattcagagggtgagtttcctcagacacaaggttcagttttcttttcccacaatttgcattcaacttactaaaacactgatttgtctgccagaaaggcagaagtagctggaaattttccctgcctttcgtttaccctcagaagtatccaaagccagaagcttttgtgaaagaaaatcatattgatcaagcaagatgcttttgccttcttccctctcctgtcgagtctcgttggcaaggctgcagtgttcgtttgatgacttcgctgtcagtttgatctgtgtaaatacgctttgcgtcctgcagcatgtcaactttcagacccaattagtcctagaaatgtttggtgccaaaggaattaaaagtcacacacctacgtaatgctgccaaaacatgaacacgctttccttaggttgtggatacagtctgtatttctttaaaattgtaagcagtctcctaaaatcctttttgcgaaactagtgtgatataaattataaataattaagattattgctgttgaatcatggatgtcttttttgagacagagtaggtgctttctagaaaaatatttgtatttgtttcattgtgctgtttcagctgaattaacagatggtttcatctttattctttactgttaaaatatatattatatactatatggtatatattatatataccatatagtatatattatatatagtatatataatgtattatatatacatacatactatacgtatatattatatatactatatatgttatatatatgctatatatgttatatatgttatatatagtatactatatgtgtatatgttatgtatgttatatatagtatactatacatatatatgttatgtatgttatatatagtatactatatgtgtatataatatatatgtataatatatacatattatatataatatatgtataatatatacatatagtatatatgtatatattatacattatatatgtgtatatattatatatgtatacataacatatactatatatgttatatagtatataggttgtatataatatatatataatatatactttttatgtatatatgttatatatggatatatgtaatatatattatatatatgttttttaaccttcttaagtgaagagagggtgaagatttgagggagtgtccattattctaatatgagttaagtagttatttacatatacaagtataaaatacatgtaaatatacatgcttgtatacaaaaacctataaaatatatttttatctcaacttttttcaagcgtgattataaaatgcaggatttatggactttcttaattatgactttacattttaaaagacaaaataaaattctgctgcagacatgagtgtggagaaatgccattgaaaacaggctgtctttttcaccctgttccatctcagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacagtgagtattcctttctgcgtgtctcttaagtcacttgtcaaagaggtgtataccgctgcaacttccagaatcaggcaagggcagaggtggatcacgaggaggccccggatttttggagtgcttgcagtcagctcacctagggagatcaggcatcagtactgataatgcctcgcagaggatggcacgtggacagtggagggtggccttggctcaaggaaggagctctggggacagggggtggagaatcaggttccagctgtgtggccacagctttggtcttgctgaacttgctcttcatgtagagttcaatttctgattccctcacctgcttccatgatccccccccccccgacgtcccccagcccattctttcctgaccctcgctcccagggtccttttccccacgcccttctaagctccctgagtttgcattacctccatctggtcagttcgaagccactccttctctgctcacaggccagctgacgcatctggaaaacgttagctaatgaagttaccccgagaaaatagtcacagatgcacacaaagatttatatatatacaaggcggctcgttacagttatttgtagctggaaaaaatgtgaaaagcattcagatgttccagatggggagaattgggaaaaagtatagaatgacaacataagaaatattttgtagttgttgaaaaaacgaaactctgaagatcaaaaattgtgcgcaaaaatggtcatgatataacattgtgaaataatagtatacaaaactatgagatccaaattttataaaaatatactgtatgaaatatgaacagagaaaagaccttggaagaaatacgtcacacaaatttaagacttgttatccctatgtggtatcattatgagtagttttggcatatttcgttgtatttttttgcattttctagtttctaccacgagtctgtactccctctgtaatgaaagttaaaactagaataattagggccatgcagtggttcatgcctgtaatcccagcactttgggaggctgaggcagttggatcacgaggtcaggagttcacgaccagcctggccaagatggtgaaaccccgtcattacgaaaaatacaaaaattagctgggtgtggtggcaggcgcctgtaatcccagctactcgggaggctgaggcaggagaatcacttgaacccaggaggcagaggttgcagtgagccgtgatcatgccactgcactccagcctgggtgacatagtgagactctgtctcaaaaaaaaaaaaaaaaaaaaaattaggaaaattattttttaagtcaccctgggctgctgcttgtctctcccccagtgctggatgggctcagccttctgaacttgtctctactagagtttggccgtcgccagctccaccccgtgctgctcccgtttttggactcccagcctcaccgcactcccagcaggtgacatttgcagaggccaaggccaccaagacggattccttgccttcccacttcaccctttatttccgtgtccttacgcttgcctctctcccctttcctctcaaacgatgcagtatggcctttctaagggtcctccgtcatcctgttcccttcttcccctctctgtcttcatggcgctattacttcttccaatctttttactattggatcctttccctcctcccacaaatatgttcaggtctccctcactcaaaatcggcagctccctgactgtgctgcccctggagctgccgggatggctccccactcccttttagtctaaccattgctttgaccttgaacgccttatgttctccttgacccttggcagcctagctttctccttgccactctcctggaacaatctcgccattgactcaaggtctatgtcaaatgagtgacaggggaggaatagaacatggatttcttgaccctctgagaccaacaatcaatccctcctcacaaaaaagatgaaatgaaaagtagccctgctgctgctgtgaattgatcccagaagttcttcccatactctgcctttgctctgctttctgcttttgtttaactgattttggctttttttgttttttgggttttttgttgttgttggtggtggtggtggttttttttgttgttgttgttgttttgagacagaatcttgctctgttgcccaggctggagtgcagtggtgcaatcttggctcactgcaacctctgcctccagggttcaagcaattctcctgccttggcctctcaagtagctggtattacaggcaccggccaccacgtctggccaatttttttgtatttttaatagagatggggtttcaccatgttggccaggctgctctcaaactcctgacctcaggtgatccgcacacctcagcctcccaaagtgctgggattacaggcataagccaccacactcaccaaggttaactgaaatttttattgagagcattacagattcatatgcaattatatgaaataatattgagaccgtgtacatttagcccagtttctgccaagctgacatttgcgaaactatagtattgcatcacgtccaggatattgacactgatgatacaattcacagatccgatttgggtttctccagttttgtttttttctcttttgtgcatatgtgtgtgtttagtcctgtacagtttgacacatgtgtaggtttgtgtatctaccacgataatcaagatcttgaatgtttctaaggccacaaaaatcatctgggttcctttatagccacacccaccttcctccagctcttcctttctaacctgtatgcctttcatttccttttcttgcatgatttgcagtgtctaggatttctagtactatgctgaataagagtgatgagaccagacatccttgcctgcttctcacctgagaggcaaaacattcagtcgttcactgttaaggatttttttttttaatcaagttgaagttattcctcactattgctaattggttctgagtttttgacatgaataaatcttactttttttcacgtgctcttactgcatcatttgacatgatcatctggtttttcttcttagcttgttggtctgttagattacattgactgatttgcaaatgtcaaaccagctttgtgtacttaaattcaacttggtcacagtgtataattcttttcatatgctgttggattgactttgctagcacttggcgaaggacttttgcatgtaagttcatgagagatattaatctgtagttgtctttttttgtgtgttatctttgtctggtgttggtatcagagtaatatggtcccatgaaatatgtttagaagtattcccacttctatgttctggaagagattgcgtaaaattggtgtcattttctctttaaatgtttggtagaattttccagtgaaactctcagggactgaagaattctttctaggaatatttttaatataaatgcaatttataaatggttttaggactatccaggttgtctgtttcatcttggctgagttttgggagttgttggttttcaaggagttgatcctctaagagttcagatttgtgagtatgaaaatgttagcagcaccaccttcttattggttgcaggatctgtagtgatgtcctgttttttattcctgatattgatgattggtttcttctggctttttaatgttgtcattcttcctggaggttcttcaattttattgcttgatttttttggtttgtttttgttgttgttgttgttgttgtttttgttttttgtttttttagaaccagcctcttgttccaggtctcctcttcttcatggtctccttcattttcaactttattgatttctgctctttataatttccttcctctgcttgctttgagtgtattttgctctcccttttctgctttcttgaggtagccatgttggttattggttgaagacctttccttgtttccagtgtgagcgtttagtgctgtacatttctgcttccatgatgctttagctgcatcccagatgttttgacactctatgctttcattttcatccagttctctgtatttttatttcctttgagatactctctgtgacccatgaattaattggaagtgtgctgttcattttccatgtgtttggagattctattgtctttctgctattgataatctgatttgattccattatgatcagagaacacacttcatataattttagttattttatatttgttgaagtttgtttaatggcctaggatatggtcaatcttggtgaatgttcaatgaatgattttttaaaaatgtctatttctccttttcaattgtaaattttatgtctcagagaaaactggaaataatctcaattttttttttttttttagaattttctaactgaatcattttttggtaggcagggagcctgtttatcctatttaggataataacacatctttgtaaatgtcaaatatcacattaaaagactgaaggtagggttgaagtcacctctggggggtgtagcttttaaaaggaaagtttggagcctgaatgagaggggcttcaggggccagctgaccacagtcacctggtactggcctccttcataaagaagaacaagaacagcaagtaggtaaccacacttcaaatagatccaagagagaagctggaattcaatagagaagtgacaggaagcacctatggcaaggaggaaagtgaagtgcagcagctcctccgggactgagatcggctgggaacccagacaggttccccactgtgggaaaagggaaagggagagacccccgtggtccacattcccaccacagactcctgcaatccgagccacaggaaagcccctcaaaactcacaggcccaagactcacgtagggagactctcacagggagaccgtgtgatgtcctgctccagagagggagcccacgctgcaccccacacgcccgagcccagagcagctactatgcagtgctgctcaaagagcccagccccaccagaacattccgccgtgggtcccaccagaccattccgccccgggtcccgacagaccattctgctccgggtcccgacagaccattccgccccggctcccgacagcctctgcatctccatattctgcagccccactgacatcccctgcccacaaccaccaccactgctggctgctgccaccagaggcaaagcacaaaccattggcagtgacccccagtggtggggctgctgggcattttcactcatcttgaggacagacttcgcttccaggcaccctgaggtcagactctcccacccacagttgccacctgggtctgaagcacacctccccagcagcagggccgcagtgcagccattgccagccctaccaagtgttctgccaggaacctgggggtcaccccaccccagctgaccacagctagcaactgcacacaccaccaggggtcctgaggacaggcctgcttggcttgctcagcctcccccagtatgagcaacactatccagggccctgggctcaccctgccctgtccaccactatgagcacctgagtacttctcctggggacctgaagtcgggcccacccaacctgctgcaccatcacagctggcacccattcctacacaccacccctgggcctggggactggcctgctcagcctgtcacagccaccagcaataccagtgcagactgctaaggagccaggggattgtcccaccactgctactgtcactgcctatagcatgcctgctgtccagggccttgagaacccacccacctgcttggccccctgcagccattgccagcacctgagcaacccacctagaatgccaagaatgagcctgtctggatcactctgggatgtaaggacaggcacactcagcccactgctgccaccactggggcccaaggattggcccacctggtgtccctgtccccagcaaaactttaccacagcctctactaacaaccacaccctaagccgctgaggaaatcacagacaccactgatgctgtttacagccaaataaattatatggagactacactactgcttcatccagaatcaaagccaaagtaccctatccaatcaacaccatagatacatcttcaggaaaaagccctcctttatgaaagcaaatccaaaaaattagaagaagcaactgttacaccagatgtgcagatatcaacataaggacacaagaaatatgaaaatgcaaggaagtataacacttccaaaggaacatggtaattctctagcaacagattccaatgaaaaagaaattatgaaatcccagaaaaaaaataaaaaataatgatattaaggaaagtcagataaaagagacacagataaataatacaaaataatccaaaaaacatttcaatacatgaatgagaaatttaccaaagagataaatattataaaaaagaaccaaacagatatccaggaactaattaattcattgactgaaatttaaaaatacaatagtaagcttcggcagtagactagatgagacagcagaaggaatttcagaatttaaagttgaataaagactatgtgatatatgagtcaccataaaggaatgagtatttgaatttttgatgtcccagaaggtgaaaagaaaaccaaagggatacaaacctgatttaacaaaataatggctgaaacccaagtctagcaagagatttagacatccagatatgggaggctcagagatccacaaataaatagatactattcagaaaggtcttctccatggcacattgtagtcaaattatcaaaagttgaagacagaattccaaaaacaccaaaagaaaagcatctactcacttataagagaacccccatcagactaacagtggatttatcagcagaaaccttacatgccaagagaaaaatgggatgatatattcaaagtactggggaaaaaaataacttgttagccaagagtactatatgcataaaagttacccttcacaaatgaaagagaaataaagtatttcctagataagtaaaagctgagggaattcatctccactggactggccctacaagaaatgcttaatgaattcccacacctgaagtgaaagaacaatatctaccatcatgaaaatgtacaaacgtataaaacccattggtagagcaaacacacaaataaggaagagaaaggacccaaatgttaccactacagaaaaccaccaaacctcaaaaataaacaatgagagagaaagaagggaacaaaggatatataaaccaaccagaaatcaattaataattactagaataagccctgacatatcaatagtaaccttgaatttaaatagattaaagtatccaaaaggatagactggctgaatggataaaaacaaaaacaaaaacaaaaacaaaccatgacccaactataggctgtgtacaagaaactcagctcacttgtaaagacacatgtagactgaaagtaaagagatggaaaaagagattttgtgcaaacagaaagcaaaagtgaacaggagtaggtacgcttagataaaatactttaagtaaaaaacagtaaaaagagacaaagaaggttattgtgtaatgataaagttatgaattcaacaagaggatataacaattctaaacatatatagaccaaacactggagcactcagatatataaagcaaatattattagatctacagggagagacagcaatacaataatacttggggactttaacatccccctctcagcattagacaggtcatcttgacagaaaaataacaaagaaacattggatttaaactgcgctttagactaaatggacctaacagacatttacagaacatttcatctaatagctacagaatgcacattcttttcatcagtacatgtaacattctccaagacagaccctatgttaggacacaaagcaaatctcaacaacttttaaaagactaaaattcgatcgatatcttcttagaccacaatggaataaaactggaaatcagtaatgaggaactttggaatctgtacaaatacatggaaattaaatagcatgctcctgaatgacctttgggtcaaggaagaaattaaggaggaaatttaaaaatttcttttttttttttttttgagacggagtcttgctctgtcgcccaggctggagtgcagtggcgcagtctcggctcactgcaagctccgcctcccaggttcacgccattgtcctgcttcagcctcctcagtagctgggattacaggcgcccaccaccacacctagctaacttttttgtattttttagtagagacggggtttcaccatgttagccaggatggtctcgatctcctgacctcgtgatccgcccgcctcggccttccaaagtgctgggattacaggcgtgagccaccacgcccggccagaaatttcttgaaacaaatgaaaattgaaatacgacatacagaaacctacaggatacagcaaaagcgatgctaagagcctacaataaatgcctacatcagaaaaaagtagaaagatttcaaacaatctagtgatacacctcaaggacaaaccaaacccaaaattagtagaaggaaagatataataaagatcagagcagacctaatgaaacaaagacttaaaaacaatacatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattgtgtaggttgcctgttcactctgatggtagtttcttttgctgtgcagaagctctttagtttaattagatcccatttgtcaattttggcttttgttgccattgcttttggtgttttagacatgaagtccttgcccatgcctatgtccggaatggtaatgcctaggttttcttctagggtttttatggttttaggtctaacgtttaggtctttaatccatcttgaattgatttttgtataaggtgtaaggaggggatccagtttcagctttctacatatggctagccagttttcccagcaccatttattaaatagggaatcctttacccattgcttgtttttctcaggtttgtcaaagatcagatagttgtagatatgtggtgttatttcagagggctctgttctgttccgttgatctatatctctgttttggtaccagtaccatgctgttttggatactggagccttgtagtatagtttgaagtcaggtagcgtgatgcttccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctaggactagaaataccatttgacccagccatcccattactgggtatatacccaaatgactataaatcatgctgctataaagacatatgcacacgtatgtttattgctgcactattcacaatagcaaagactttgaaccaatccaaatgtccaacaatgatagactggattaagaaaatgtggcacatatacaccatggaatactatgcagccataaaaaatgatgaattcatgtcctttgtagggacatggatgaaattggaaatcatcattctcagtaaactatcgcaagaacaaaaaaccaaacacggcatattctcactcataggtgggaattgaacagtgagaacacatggacacaggaaggggaacatcacactctggggactgttgtggggtggggggaggggggagggatagcactaggagatatacctaatgctaaatgacgagttaatgggtgcagcacaccagcatggcacatgtatacatatgtaactaacctgcacattgtgcacatgtaccctaaaacttaaagtataataataataataataaaaacaatacaaatggttaaacaaaactcagttttagggaagatacacaaaatcaataaactgctagctagacttaagaagaataaaagacagattacttaaggaaacaaaatcagaaatgcaaaaggagacattataactgataccacagaaatacaaaatatcatttgagactcttactaacaactatacactaacaaattggaaaacctaggagaaatggataaattcctgaacacatacaacctaccaagattgaatcagaaagaaacataaaatctgaacagactaataatgggtaatgagattgagtcagtaataactctcccaacaaagaaaaacccagggccaagtggtttcactgacaaattctaccatactttcaaggaagaactaaaaccaattctcctcaaactattccaaaaaattaaagaagaggaaattctttctaactcattttatgaggtcagtgttacccagataccaaaaccagacaaggacataacaacaaaaaactacagtccattatccctgatgaacatagacacaaaaatcctcaacaaaaatattagcaaactgaatccaacagcacgtcagaaatataatacaccatgctcatgtgagatttatcccagggatgcaaggatggttcaacatatacatatccataaatgtgatacatcactccaacataataaaagacaaaaaccatgtgatcatctcaacagatgcataaaaagcatttaataaaatttaacatccctttataataaaaactctcaacaaactaggcatagtagaaacatacctcagtatgataaagtctgtatatgaaaaacccacagctaacatcacactgaatggggaaaagctgaaatcctttcctctgataactggaacaagacaaagatgcccactttcatcacacctatttgtagtactggaagtcctagccacagcagtcaggcaaaagaaaggaataaaaggcatctaaattggaaaagaggaagtcagattgttctctttgcagatgacatgatcttgtgtctaaacaaacctagactccaccaaaaaactcctatatctgataaataaatttggtgaggttgcaggatacaatagcaacacacaaaaatcagtagcatttctataaaccaataatgaactagctgagaaataaatcaagaagttgattccatttacaatagctataaaagaaaaacatatctaggaattaatttaaccaaggaggtgaaagatctctacaaagaaaaatacaaaacattgatgaaaggaactaagaaactgaagaagacacaagtaaatagaaagacatcccatgctcatggatcagaagaattagcattattaaaatgaccatactccccaaatgaatctaatgactcaatgcaatctctatcaaaataccagtgtcattttcacagaaatagcaaaaaaaaaaaacaaaaaaccccgtaaattcttgtggaacccaaaaagagcccaaatagccaaagcaatccatagcaaaaataacgaaactggaggaatcacactacctatctttgaaatatatgacaagtctataataaccaaaaccatggcatggtattggcgttaacaacagacacatagaccaatggaacagaatagagcacccagaaacatatccatatatttacaaccaactgattttcgataaaggtggcaggataccttcaataattttggtgctaggaaaattggatatccatatgcagaagatcgaaattaaaaaataactcaagatggattaaagacttaaatgtaacacttgaaattataaaactactaaaataaaacacaggggaaacacttcaggacattagtgtaggcaaagattttatggctaagatctcaaaagcacaggcaacaaaaccaaaaatagacaaatgggactatatcaaacttaaaaacttctgtacagcaaaggaaatggtaaacagagtgaagagacagcctgttgaatgggagaaaatatttgcaaactattcatctggtaagggattaatatctaaaatatacaaagaactcagctcaacagtttaaaaaatctcatttaaaaagtgggcaagggacatgaataaacccttgtcaaaagcagacatacagatggtcaacgtgtctatgaaaaaatgcccagtatcactaatcatcaaggaaatgctaatcaaaacctcaatgaggtaccattttatcccagtcagaatcactagaattaaaaagacataaaaaatgctgacaatcatgtggagaacagggaactctaatacactgttggtgatgatgtaaattagtacagccacaatggaaaacagtataagttttcaaaaaactaaaaatagaactaccctatgagccagcaatcccactattgggtatttatccataggaaaggagtcagtgcatcaaaggatacccataccccatgcttactgcagcaccattcacagtagccaagatacggaatcaacccaagcgtccatcagtagaccaacggataagaaaatgtggtgtatatacatagtggaatactattcagccacaagaaagaatgaaatcctgtcatttgcagcaacatgcagggaactggagggcattacatcaatgccctcaggaaaacaaatatcacaagttctcactcataagtagtagcttaaaaggccaatctcatggagataagagagtagaatgaaagatactagaggctgggaggggtgtgtcggtggagcagggtggtggggagaaagagaggttagttgatgggcataaacattcagttaaacagaaggagtaagttccaatgctccgtggcacagtagagtgactacagctaacaatgatgtatatttcaaaataccaaggaaagaggatttcgaatgttcacaacacatagaaatgataaatactccaggccataggcactctgaacaccctaacttggccgttacacagtcagtgcctgtaacaaaacgtcacctgtaccatagaaatgtgtacaagtattatgtatcaataaaaaagaaagtaaagaaagcttcagactctcgggtgctggagaaacggcctccttttctctttagctgatggtgctgtagttagttccacacccagcaggacttctttcccaaagctccgaggaaatgagaagttgttgggagagggtagcagtaaagaggaaacagaatataaattttaagctgagacatcgccagctgattgcagcagagctagaggacagcatctttgggcaggaatccaggaagcagaaacataatataaaaggagcaaaaaggtttctttccttctccatcgattgaaaaaagaacaagtcagtgcaaaaatctgtcagaatgtctttctggaggctcacaattgtgggaggatgagatggtcttgacagccattctattttaccatcttccacactagaaaagtgaaatttatcagagcatttgagcttatctgtgaaaagtcttttcaaagtttcacccagatgagtggttgttgtttttttttttttttttttttttttttttttttttgaggctgttaccattttaaaaaaattacgacttgtgttagaaggctttgtccaagtaccaactcagtgctcggtatggaattcaccctaaaaatctaatgtttgtgcaagtgaggctggcagtaaccagaacagggactttgcaggggtgagacttctctgtaggaatcctggatactctttcaggacaactgacacccttgacttcatgctctcctattttaagctgaaagacttgcattttttattactaaaaagatttgaatgtggcgccatccagcaggttcactaggggagtcgtgtggtgtggagctttcagtaggaaccagtgttccctgcctggcgtggagggtgtactcagctgatacatacagaaactgacggatgtctcgtctcttctccatcattcttttcctcccttttccccggttctgcctttgaactaccctttcctcctgcccttttctcctccctggctttgtcgctatgtttctcctgaacgggtatctggaggggtaggcatgggggcattgtcagagaggaggtagggctctcaatggcaggcggggaagcagggccaacccgggcagctgtgtttgtgtttgctgctgagatcaatggatggaggggcactttcaggcaccgcacaggtgcctgtggtgcctgacttagggaatgggagtgcactgtctctcttcccctcatccttccctccatttgctcgtaagacgccagcctccccaaaagcgtttccatttccacctgctcctcatgccttgcacagcagctatggctatagagagaccatggaaggcacatggcagggcttgggagtaacggcatccgggagaacatcaccatcaggacatccacctatctcctccagatagccaggcatcctctcctccctccccatcaccacacagtgtgggctggccctgatgggaccgatgggacctgctatgggaacactaaaaggctctaaacctgggtgagctggtgcaagagatgtgggtcagaactgccagatgtccctgctgtccggccagcagcgacttgctgtgggccctgctgtccctgagtcgcaggcaggtggtccatctgcatgtggggcggagctctgcgcctgtggccgcccttcctcaagcagtttgctttgctgagctgcacctgcatcttggatttttaactcatgttttagactctcaggtcttttctctggggtggcatcctctgatcctaggaatgagtttatgttctgatgagaggttcatcatcatgacagcggctgatgatcatggaacattttcatggtgcccgggacatcctcgtgttttcatgttttattacaatttattcttataattgtctcgctgagttatttttattttccctgcttcacacattaacagactaaggtgtcgagagtgtaatttcctaggcagcaagtagctcagccaggtctgacacccagcttggacgccagcgttcaagcgtaactctgcggctctgcctgcccgtgttagcaagggggccgcagggcacagaagctcctgggaaaggaatttgtttttgctgggattttctcaggccactgcctcgcccctctggaatccttcaggataccgattgggtttggagcctggagttctggaccaggttggcaggtgagcctgcccctgggcccagggtccttttctggtttgcacaaggttacagatggcccccacacaagccagacacggggttgcatacaccatggaggaacactcagaggaggcagttgctcttgagaatccagccagcctgattgttctaatcagattagatcaaggagaaagacagagaatggtttgtgtataaatctcctgccaccagtagctccagtgccctgtgtggctgggatgaagctggagaaaataatgtgtgtgatgatagccaggatgccttgaacaccctccttctttctgcattccactgatgtctcctgcagggttttgcagccccagctcaccactttccttccatagttagaaccttccccacacatctgatcaaaagaaaatttgggctattgtgttaacagatgactttgcttttaattggtagaaccaggagctgtgggacatctgagtttcacagagatcttggacacatctctcaaggtcagctggcaggagcccctggagaaaaatggcatcattactggtaagtaggcctgtccttcaaaaaaggaaaagataagtttgtcctcacaaaaagaagtggctgtcacttcaaaccaaactgctgacagcatggacccgtgcccatggccttctcaagaggaactgaaaagtcttcctggccgtgtggcagagtcccagcactgggactgccccagtgagagccagcctggtctggggccctttactgtgtgggcagcagccatagtttgagatctgttctcctcgcatgatcttagtaggtgtccagagtctctgaccaatgagagtcagtcatgttatgacacatttgttcacatgcgtgtgtcttgcttaattctcatagcagcatggtaaggtcaatatcgatattatgaccattttacagatgaggaaactgaggccccgagagggtgggtgacctttccttcattcagcagatggcactgagcgctcctgtgggcagccagccttctcagacacagccaggtggtgtgactatgaggcttacgtgcctgtgtctcagccctcgtcccacagctgtgagccgcaagggtgagatctgggtcttctgactccagatcccatgttctgtcccctccccaccctgccctccagtgagagccctgaggagactgtgaggcaggtacttcggaggaggttctgagctgtaccagggatgggggctgagccttagaggcccctgggcagtgagatctcctctcctggtttgagggggtctctgtgggagacagctcaccttttttagggtttttaatgattttatttatttatttatttatttatgagacagggtcttgctctctcgcccaggctggagtgcggtggcgtgatctcggctcactgcaacctccacctcccgggttcaagcagttttcctgcctcagcctcctgaagagctgggattacaggtgtgtgccaccatacctggctaatttttgtatttttagtagaaatggggttttgccatgttggccaggctggtctcgaactcctgacctcaagtgatccacctgcctcagcctcccaaagtgctgggattacaggcgtgagccactgcgcctggccaaatttttataatgtctctgaaaaaccttttaggttaaagcttaatttaaatcttagttcaaaaaaaaaatcttggtttgacaaaagcaacataggctctagcctcagatgaggctgggcagggccccctgttctactgttttagtcactctaagagcctcagcagacctctgggatcctcagttacaactgaggggctgtcaggaggacgagttgagagaagttgtatcagtggctgcccactgcctggcccagaacaactcagcctccaacagacatctgttttttttctaaacattaccaaggatttctagcaagccacttaatcttcttctctgtcagccatatataggacacttctgtgtcagccctctctgggggctttgcctgtggcatctcatgtcccggcaggggctcctgcgtgggtattctgcagccgcaccccaaggttgagtgagttgcccgtcctgacgcgagcggtcagtttggagctgagctgcgtctccgctccgtggtggcagcgttctcagctgcctgcgggagccatggaattcaagtgcctgattgttctgtgaagcaagcttatgctctctgggtgtgtcctagaagcctgtgctgggactgtgctgcccagagaccaagagcctcaggtgatctctccctcctgccaggctgcagggttgggggccgtttcttctccgcactggcgtcctggatgacagcggcaatgatgaccctggccacttccactgtgtttgtcaccctagccttgtgggatctcgttttgctttctcagcaaccacacaaggggtgtcttataaccgaggcctggcgatgacaaggctgaggtttagggtggtgacgtcccaccatcacagccaatgggcatgtgcgcattctctcctctgcagcgttgatgtggtgggggtgaggtttgaaccatgctctgaaccccacagcatgggatgctcactttccccatccacagtcctcttagcatctccataatttctcaaagcaccctgaggccacagaaatgcctgacggttctgtttattaagtagttaggtccaaacaacggaagtgttaatatgcgctaacaattataattgccatgtaaaaaatactacacagtagttgaaagaaataatacttgcatttcttttttcagtgaccacagttagttcctaatgggatgtctgcacccgcctgggactgcccaccttctcagaccttgggaccagatggtccctcgtcaccctcatttcccggttcactttggtttccaggcagtacttgtttccttatcacaacatccaccaaaaactctgctttgcaaagacaggatatatccaaggactcgtggcatgctctgacccggaaatggagccacctcgggctggaggctcacgtgtgtcccactggcattgagtgtcctgtgcatccctgcagtgctcctgggaggtcactgcagcatcccaggtgccctggggcacagtgggagactgtgttcctacagtgacctctttctacacagaactccagctacatagcaaacccagtgccaaccccaccactactcatcagtagaatctcctgtaatcatctgtgccaaccagatcccctgatagagcggtgtgcccacagcccatacacaaggtcaccttggagccagtgccacctctcaaatttttttttttttttttgagatggagtctcactctgcagcccaggatggagtacagtggcacaatctcagctcactgcaacctctgcctcctgggttcaagcaattatcctgcctcagcctcccgagtagttggaactacaggcgtgagccaccacgcctggctaattgtttgtatttttagtgaaggcgggggtttcaccatgttagccaggatggtctcgatctcctgacctcgtgatccacccactttggcctcccaaagtgtgctgtgcctcttataagcatatagctggactttgtggggtttttaattttttgtttatttattttttgaaatggagtgtctctctgtcacccaggttggagtgcagtggtgtgatcttggctcactggaacatccgcctcccggttcaaatgattctcctgccttagcctcccaagtagctgggattacaggtgtgcgccaccacacccagctaatttttgtatttttagtagagacagggttttaccatattggtaaggctggtcttgaactcctgacctcaggtgatccacccacttcggcctcccaaagtgctgggattactggcatgagccaccacgcctggcctcaccttaacttttaaaaaaagtaaattaatgaatctggctctgccttccagaagcttatcttttgaagtgcccactttaaatagtgtgaaaactccaggaatggggggaagtcactactagaattggacacaatctgttgcacattctgaagtcatctgagaatcgcaagtgctgagtgtgtacaattaaaagggcctcctgttgcctggagtcgaaggaattaagcaaaggcagggggaactgagcaggggagggcactatagactgcaggaacctagtttaatcttgctttaaaccattcaaagaaaggaaaaacaaactagtgggaggagggatttttaaaagctgagcaggaggctaccattcggaagaagaagactttccagttcagacccttcagggaccagttcagtggctggaattagagctctgcttaccactgatcccagaaacggggctgcccgggtaggaaagaaagaattctggcctaccgtctgcccagtcgcctttcaggtctgcagtcggccatgttttggaaatctggcagagactccttggtagatgtgtgtacacagaaggaattccctttttacagatacacacgttagcccctgccctgccctttgtgaacacagcacacacttctttcctgtttaaagctgaaagaaaaaaatccatgggcataataattcacgttgagccaacatttcacggctaagcagtggttgccaatacttccaatttatgatcgtctgtttcaccagctaatggggcttcatgaactcattttcatgttttatttaaacaaatacctgtagttaaaagcagcagtctgttgtttatggtggagcttgacttcgaagctcgagctttcctgggctgggtgtagccagaggcctgggtttggaggtgcctgtgctgtcaggggcagcaaagttgcagtgagagcaccaggcagactctctgcaggttcctctcggcagccacgttgtccccttctgtgtgtggcctgtgtgttttcccttcctgctcactgtaatgtgcaccttgtgtcacagaagctgcagtggacgcctgcagctctttggaggagaaggtcctagaggagatgagatcggatgttatcaccttaccagcccagcatcaccctgtgcccccagtgatgcccgcatcaggggagctccccccagcacccaccatgtagacatagttttccagtggaacatgctggcagcaccatgaaattctattctgtgctgaaggcagagtgtctcattgagaagagcaaaagaaaaactgtgttcgtgggcaaacctggctgccggtttctggaagtgttggtgcggcaccaccatgctctcgcaggcttcctgcaaaggctgcacctgctattaaaggcagctgcaggagcccaggatgactgacggcttgggcctgggctcagcaccactttacgggccagaggcgctgttggaaacgtaggtttattagccctggtctgtggtgagcacccccagcttccattttaattcgaggcctggaatgagagggaagcacggagtagggggcggctgcgcctgcccgagtaaattgcccattgcccgctcattgtaaatttcagcgtcctccactctccttcagtaaactctgatttatgagggccaggatgcagacagacagtttgtgattggatgcactgctctcttctagagaatttactttagatcaacagaaaattatttctgaagctcctctggccattagtctcagttaggcagccattgggagcaggtaggatgccaagcgggaggtacccccgctcctggctccgggcgcctctctcctctctcctctgggagctggaagcagaggatgcatcccctggccagcactgcctgagccctccacgcacctcccccaaaagctgttgttcataaattaggggacgtctttcccacctcacgcccaccactctgtctgtgctcacaggcatcacacgtcttgggcctgcaccatttctgctggcgtttctctgcagatcagcctctctagctatccgtttggtttttgtttgtatccacaaccatttgagcacactatattatcaatgttgatcctaataaattctatcaacactgctcttcctgaagatgctggaattgccgtgtttcagctctaggtcgacatgacaaacatgacgctgtgtttcagtaaattctgatgaaaaacagcttttaaacaaataaaattttctggcagacaagttgtaatattaaacaaagtctgctcttcccataggttcagagtagaccccgaggatcaaattatttagcgattgaccaggtgtgacccaccaaggtcagggatgtctcagttcccttgcacacatcaggaggaggtgctggaggaggaggcgctttgagagcagggtctcgtgcaccatgagaaacaaactcacccgtccaaacccaaagaatggactcagagacccggagaacagcgaaagtgagacttttaatgccggtcttgcaagatcgagtgtgtggtgggcaggcacactcagcacggccacaacaagcgatttatcccctagtgctcaggcccctctcccagttcctcataggctgagcactatggggtggggcgggggaggtcacagtcttcccggacatcgcctattggttgttgggcagggggccgtaggtgtttttttagggttgtcctgttgcattttgttgcagcccacaatgcactgcaatcctagtcagctcagggggtcttcaggtatttgacttacgacctaagtagctgggcaggctgataagaacagacgaaacgagctattctgcaggatagtaaactttcatcttagactaaacttctttggttggggtggggacaactgagggattgggggaggctgagaagcaggcatttgcgattgaagcaggggcttagtgtatcctgtttcttctgtagtttgctgacctaagctgattcaaggtactttgtcttggaaacggaccatgtatccattatttccttcatccactgagggctgtcttgggttccagcaagtccacgaagctttctgtggcttggtttcttcctttgtgaaataggataacaatggctccaatttcaaaggtgtgttgtgagggttacatgaatgaatggggcaggctagatgtcttagacgtcagggtgggcagatgagggaaatgctaagatgtaaagcgagggcagggcccaggctgggcgtggtggctgacggctgtaatcctagcattttgggaggccacggtgggaggatcgcttgataccaggagtttgagaccagcctgggcaacacagtgagaccctcatctctacaaaaaattttaaaaacttgccaggcatggtggcacatgcctatagtaccagctacttgagagactgaggtgggagaatcgcttgggttgagtggttcaaggttgcagtgagccgtgatcaccccactgcactccagcctgggcaacagagcaagactttctctctctctctctctctctctctctctgtatatatatatatatatatatatatatatatttttttttttttttaataaagttaggaaggaaatgggagaaggcaaaaatgagtggttggcctgggtagtcggccttctcccctctccctgggaggaggaaaaggagaccaggacctgagaagcagccaggcgcctttgatgaagacaccacagaggatggtttagtgaccctcctgggcccaggcagagaccccaaaggcaggcaggcagcaccacttggtgacaactcacaggatggcaggtgctccaagtgctctggaggcacccagcagccaggcctcccctctggtggcccttgttccttggagctccccactgcgtccgcccacacgggagtcccctcagcccgcacacagaagctgccaggctgtacggggcctgtggcacggccagggggagcagtttacgacattaaatttttttcaaaatataaagtctcaagatgctgtcctctaaattcttgtttacctgcaagtgcaactcctagctttatttattgctttcatcagaatgaggaggaagtttcaggtgcgtcctagcgcttctatatccctgaggttattgactagaaatagggaagagcaagcgttttcagctgttttcttttgcctgtggacctatgagctctttccaccactgtctccctctttaaaagacacttttaagtgctctctgatcacattaactcccctccacgcgggttgattgattcaggagctagttgggtcttatttctccttttttttttttttttaagacaaagtcttgctctgtcacccaggctggagtgcaatggcgcaatcttggctcactgcaacctccgcctcccaggttcgagtgattctcgtgcctcagccttccgagtagctaggattacaggcgcccaccaccatgcatggctaatttttatattttagtagagacggggtttcacatgttggccaggctggtctccaactcctgagctcaggtggtccacccgccttggcctccccaagtgctgggattacaggtgtgagccaccgtgccccgcaggtcttttttctctaagccccaagtcacagtggaatcccaggttgaataaattttcgtcatgaggccccactggcctgaagagagtatagggggaaatcaaatttattagaaaacaggatatatgaaaaggggagagagagctagaagcaaaactcacacactcaggtgaaaataaacttttccagtgcattgcaaaatgtaagagtaatctgtcagtcatttcttgaaggaaaaagtagaagtgtttccatgaattagttgcaaccgaagagcaagccattgatttaaggtacaaaaaatatcggcttccaaaaatgaaatgattggccgggtacagtggctgtaatcccaacactaagggaggccgaggcgggaggatctcttgagcctaggaattccagaccagcctgggcaacagggggaaaccccatctctccaaaaaaatacaaaaaattagccaggcatggtggttcacgcctgtggtcccagctactcaggacgctgaggtgggaggatggattgagcccaggaggttgaggctgcagtgagctatgattgcaccattgcacttcagcctgggcaacagactcaaaaataaatagatagatacatacatacatatatacatacataacattttttagtggaattattggtgaaatgcattcataatttgacaagagaaggtcgaattgagcacagcaggctggcagctgtcgtcatgtttcagttcacgcacctggtgctgaggttaccagagcatcccagaggccctgtccttatgaagctcgccctggtagggagggatggtcccctgtggtgggaccgtcactcccataagcaggtttacgagatcgcattgggcacacagaggaaggagccttgacctgtgtctcatgtcagtagcacagtggctctaagctgccttcagcacatccagccaagctctccatagctccaagcctgcaacgatggtgctgtggaattcaggtgagcccttggccttcaggagaccaacactggtctggtcctgttgctttctaggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccaggtcagtagaatcgtgtgcggtcctcctgctgtcacctttctcttggagattcccgaggctagaagttgattggcactttggtgtggaagccactgagtgccttgaaaaggagtagtggcctcctgccaagatgctggagggtaaatgggtgttgaccccacttcagccccattctccagagcattccaccacggcctcacgtcccttctgtcttcccctcctgctttggcctcagccagttcccagaacatgcgttgaaagtgtttaaagccagttcccaatgcatatctaaaatgccatgaatactttcaaaacagtagcgatgattgtattagtccattttcatgctgctgataaagacatacccgagactgggccatttacaaaagaaacaggtttaatggacttacagttccgtatggttggggaggcctcacaatcatggcggaaggcaaggaggagcaagtcatgtattacatggatggcagcaggcaaagagagagcccgtgcaaggaaactcccgtttttaaaacccatagatcttgtgagacttattcactatcatgagaacagcacaggaaagacctgcccccatgattcagttacctcccaccaggttcctctcatgacacatgggaaatgtgggagttacaattcaagatgagatttgagtggggacacagccaaaccatatcaatgatgatggtgtgtggtttaattgggtaaaaattggtatatatagcgaccaaggttaacactagaagcacatctgggtgcaagttaccagagttttcctgagatgtcttggacattgtttatccagggcagggaaatgggttagctgacctccggaaggctgtgcttccagaaacactctgacgcacactacgtctggagccacagagtggagtgttagaggggaaactgaggcctggctgctttggccaaacccctgataaccaaggtgcagggaggcactggagttgctgttccgtcattgccaaggctgaacgcttgtagctggagaggggtcttaaagccttacccactcatcctgggtagtggctggaggcaaatcaaatggcgaggactgctttggggacaccatgttctgtttaccgtgcttgaagtttatcgccattaatgattgaagaaccatttaaaaatccagagagctgagaaataggaaagagtccacttgtccttcaatttaaacattttctatttcaaattcattaaaaactagatgtggaaaggacccttgagatcctacagaccctgcccatgccgatactgaattgatcaccaaaatagtttcattgtccctgtgcaagacctggtttcaaacaccccaagcaacagcaaatgaggaaagcattcctcagagatagtgaggtctgaaagctgccctagccttgcatttttcttttctttttcttccccattttatccccttatctttctctagagtattttgcatggcacagtaacacgaaagctctcgttttgaactcataatgctacaattccgggtgggagatgctctttggggagcggcatctgaagggtctctcatctaggagtaggcttgagccacgggcaccctcaacgggaggctcattcagaacccaccttccaccttatccagttgcctgagcaactgaatagaagcagagaaaggagagttctgcacttgcacgagaatttgttcgtcttggaaacgaaatccaagaagcctaaggctcaagacctgatcctgaccgggtgtcacgtcgcctgggagcaggcgatcctgaccgggtgtcacgccgcctgggagcaaccctgggcctatgcactcttccctccatccctccgaggccgcggtaattatgaaaggaagtacggcccgctcgttctctgtgtggtttgaggagccaggaagaattacattcattcatcctttcctcattcagccagcatctgttaattacctacgaagtacagagatgcgtaagacatgacgtgtgcctgcagagtttctcatcagggaggccatgttagcgacgtgtctcccaaagcccactgggtcaccccattaaagcaaaaaccatgcactgatcatgcccctggggaagctgtgctgcttctcaccttcatggttttgagagcaaatccttttttggtatagaatcgttttgaaactgtttacttttgaagctgacacgtttgatacctttcctaagctgtgacggactgtaaatctctccctttcctccctggttcctctctagaccttcctggtgccccatccaacctggtcatttccaacatcagccctcgctccgccacccttcagttccggccaggctatgacgggaaaacgtccatctccaggtggattgttgaggggcaggtacgtgtgtcgttagactgggagctggcatttgcgaagagcagtgttggggcctgtgaatgagtggtacccctgcagatgatggcttggggtgtcggggagatgggtgtgcttggagagggagaaccaggggctggagatagcccagataccagggcagaatgtaggaagacaaagaacaagatgtcaggccggggtcctaccaggtgataagacaaggataagaagggttaaaatgaaagttgtgattcaaaataggtacccaaaattggatagtgtcgttgattgagtttttaaaaattctatatcacaattagctactaaatatactaataggattaattgcttggtacagcttgtgtgtcattagctatgcattcattcaacaatatttttagagacgattgttctatcagcaggcactattctgagcacgggggctattgcagtagacaaagctggctgagtttctgctgtcgaggagaaaagtgctgtctgggaaagaaagacctccagctgtgggaaagctgttatatttgagggacagcgaggagggtgggtgctggagggaggggagcaagccctgcggtggcagggagtgagtctggggagagctgggggcgggttccacaggacttgagagagtggactccgccgagagacttccggtccgactccagctgtgcaagtgctggagcacgcaggggtccgggacagtgccaggcttgaataggatcatgctggcattggtgaagccgtgcaatctgccacttccatgttccaataaaagcaggaggaaaaagataaagggccaaattatgaggagtagtaaagtttcaaaatagttattatctgtagtaaaatccttgtggttttcatgactgtacttatgctatactgcaagacgatccactcctggaaattggccgtaaattagggaacaaatcctatctacctcttcaaaagtttcattaagcaaacatttctgaaagtctaaggaggatcctgaaggcgcaaaccatctggatgggactgacccacaaatggggctggaacaattatttacttaggaaaaatagcagtagagccctacctcacatcatcacacaccagggactgttgtggcgttgagggggtggggagggatagcattgggagatacacctaatgctaaaagacgagttaatgggtgcagcacaccaacatggcacatgtatacatatgtaacaaacctgcacattgtgcacacgtaccctaaaacttaaagtataataataataaaattacaataaaaaaagaaaaaagaaaatcagtcttcagcaaatgaagactaaattgatgaaagcaaactttaaaacgcttaggattaaatataggacaagaatcacaatgtctcatgaaaaccaattctactattaaaatccatctgcagaagtagccaggcaatacttttaggcccgcagaagcacgcgctgtggtctttggtgtctgacgatgccgcatagctgaggccaggaggcagcgctctctgcaggctttagaatgtggtgttacgctagggctaggcaggccacagcgacagaaacgccagcgtcttcagggctcaacatacaaaagctcatctgtgcatccaggcaggcctaggagtggatgacgctcctttggcccatgttccgttgcccagaacttgggcaacgtggccctgtgtcactgcaggagagtctgagagtgttgcatttcagctcatctgggagggaaagacaaggagtgatgtggggaccctcaccacagtttcttggccatagtatcctagctttatgtcatacaacctgtttctttaatttttttttttttgagacagaatcttgctctgtcgccaagctggagtgcagtggcgccttctcagctcactgcaagctcttcctcccaggttcaagtgattccccctgcctcagcctcccgagtagctggggctacaggcacccgccacccacccagccaattttttgtattttagtagagacggggtttcaccatgttagccaggatggtctggatctcctgacctcgtgatccgcctgcctcggcctcccaaatcgctgggattacaggcatgagccaccgcacctgacctgtaaagaggttttacatttttaatgtaaaacatcttaaatatatgcaaaaggaagaatagagtaagccctcttatacccatcagcaaaagtcaatgatcctcaagattttgctgcatccatccatccctggttttttattggcgtattttgaagcatatttcagaccacatgtcacttttcccccatacacatcacacatgtgtctaaaatgcctgttcacatgccaatatggatgaatttcacaggcataatgtttaacaaaaggaaaaccagacccctgcttggagcatatactgtgtgattccatttatagaatgttccaaaacaggaagaagtaatctttggtgttggaataacaggttttcctgggacccttgtggttacttaccgtgggggtgacagtgactgggagggggccacctgaggagggggcgtctggaatggcaggagtgctgtcttttgatctgggtgcttattttgtgtatacaccagtcgtctgtgagcttgcctgtatgtcttacttcagtgaaaactttggccaggcgtgatggctcacacctgtaatccacactttaggagaccaaggcaggcggatcacttgaggttgggagttcgaggccagcctggccaacatgtgaaaccccatctctactaaaaatacaaaaattagccaggcatggtggcgcacgtctgtaatcccagctattcaggaagctgaagcaggagaatcgcttgaacctgggaggcggagtttgcagtgagctgagatcatgccactgtacttcagcctgggcaacagagtgagattctgtctcaaaaaaaaaaaaaaaagaaaagaaaagaaatttttacatgaaaatatggatgtcttttctcatgataccattgtcacacctgataaaattattattatttttttgagatagaatctcactctgtcacccagacaggagtgaagtggtatgatctcggctcactacaacctctgcctcctgggctcaagcaatcctctcatctcagcctcctgagtagctaggaccacaggcgtgtgccaccacaccagctaactttttatatttttggtagagacagggttttgctgtgttgcccaggctggtctcgaactcctgagttcaagcgatctgtcagcctcggcctcccaaagtgctgtgattataggcatgagccaccgcacctggcaatttgaacattttaatatcatctaatagtcagttcacactcagattcccccaaattttccaaaacatctctttacggtggttttgataaaagtaggattcacgcagggttcacactattcattttgttgtcatgtctctcaaattgttaaaaaaaaatgttaacagctttattgagttgcaattgacatacaggtttaaactgcatatatttaagatggacagtttgacagcttttgacttagctacacatatacacacacctgggaagctgtgaccacagatgagataatgaacaggttcctcaccctcaaaggtgtccttgcagcccccactatccctccctaccaaccctccccgtccccacaaccactcatctgcttcctgtcactataggttacagctctgttaatctagtggaatcccccactcttttcccccatgcagttgcctcgttgagaaaacccagccagtcatcccatgggacatctgcattggagatgcacctggttacatccttgtggggtcacttgacctgttcctctaccccgtttgccctgtaaactggaagttcattgcaaagaactggtagattccatttccactcctccctccctccctccctccctccctccctcccttccttcctttttgcctccctcctcccttctttccttcttctctccctcccttctcttgtccctccctccctcctttccttccttccttcctccacccctcccttctttcctccctctctcccttcacttcttccctccctcctttacttcctccctcccttctttacttcctccatccctcccttcctttacttcctgtctccctccctcccttctttcctccctcctttcctctctccctcccttccttcctttcttcctctctcccttcctctctctctctgtctgtctccctccctccctaagactgcttccctgttactacagcagggtgggggcacgtaggtctagtcgccccactcagggatgctaagttgggtggcagagcgtagcagcctgatgcctaccttgtgaatttctccatcagctttttatctaatggtctcatccatccatgatctttgcctgaattaattatgttcttaggatattcaagatgataattttatatttctatcagtctttcctcatttagctgttggaactctaaaaagaagcatctctgctcatccctcagactatttagttactctcaaatgcaggaaggcagaataaatgcttaattcttttcccttaattaccagtttccagggtgaggaattggtcccctggttacttccaatgttaaatagatttttctttctttttctgtcttgtgatctcttttgctgagtatcatcatgaaagcataggttcttacctgttcagtgggtttcagtcacctgcagtcattattctttttgaacctagaattggcctgtctttggcctagggaggctttcgtatcctggggctccggcatgaggctccactctttgatgacttcctgcctcaagctgagatggagccatgcctgcagggccttggtttcatgagtgtcaaatgctgtttaaagacgataacctgagcaccaaggtggatctcctcgctcccagctggtccctgcttcgacaccttcccagtagacagaacatattttctgaagcatcatgagttcatactgacgtttccaatgaaatttcaggttactgaccttaaatgtatatgttatgttacgttatgttatgttatgttatgttatgttatgttatgttatgttatgttatgttatgttgttacttaaatgtatattttattttattttattttatttatttatttatttgagatggagtttcgctcttgtcacccaggctggagtgcaatggcacgatctcactgcaacctccgcctcctgggttcaagtgattctcctgcctcagcctcctgagtagctgggattacaggcgcccgccaccacgcccagctaatttttatatttttagtagagatggggtttcaccatgttggaccaggctggtgtcgaacaccttacctcaagtgatccacctgccttggcctcccaaagtgctgggattacaggtgtgagcccactgcgcccagcctaaatgtatattttaaatatattttcccttactctaagactgtgctttttaggactcctaactcgattatcttctttatcctcctattgtattaagaggttcaacctgtggtctgtgaatttgcctgtgtatcttacttatatgaaaactttatgttaaaacacaaatactattaggagtttcaaaattataatctcagtggtatgactaacagagactactgaatgaaatttaagtatttgtccttaaaatgtgttataccatggaagtgtaatatattcagtttatacctacagtttatattcagtttataatatatttagtttatacttacagtatacaagtacagttgcagtactgttctaaagccactgttcttttctcattgtggttatctcgatacagatttaagtgcgttcatttcaggacttgttttgtttttttgcttcaatttttagcactgactttctttaaaaatcattttacattttttttatttatttattttgagatggagtctcactctgtcaccgaggctggagtgcagtggcgtgatctcagatcactgcaacctccacctcccgggttcaagctattctcctgcctcagcctcctgagtagctgggattacaggtgctcgccaccacgcctggctaatttttgtatttttagtagagatggggtttcaccatgttggccaggctggtcttgaactcctaacctcaagtgatccgcccgcctcagcctcccagagtgctgggattacaggtgtgagccactgcacctagctcattttacattttaaaaaattggtggaggattttaaactaattcttgaggatataactcatttacacgatctcaaagtcaaaactatttaaaaagtgacattcacagaagtttctgttcatttgtctccttaccctgttgcctgtctgccacatagataaccatatttattagacttttggtttttcctttttctttttctttctggcaacataaacagctctgcgtatatgtgtacttcctctttcttccacggaaggtggcatattgcgccttgctgtcttccggtgacagcacatcctgaatacccctgggcatcatgtgtgcacttgtcctttcttctcacacctgcacaggtctgcccggtgtgcatgagctggggtttgtttatgtagctagtcctctgctgacacgcattgggatgtgtattagtattatatcactgccataacaaatcaccaaaaactgagtggctgatacaacatacatgtgtcatcttctagttctgcaggtcagaagtccagcatgggtctcaccagagccatgtttcttccggaagctctggggatgagtcagcttccagggtcattcgggttgcggcagaattcagtccttgcagttgtaggactgaggtccccatactgtgctgtcagccatggtcattcccagctcctggaggtcaccacggtctgtggctcgggatccccttccttcatcttcagagcagccggggcaggtcaagtcctctcagactctggctctttcctcctccttccttctcatctctctggcccactcttcagcctcccacttccacttttaaggactcctgattaccttgtattcacctggataacctccctgatgtaaggttcttacccttaatcacatctgcagagcctctcctgccacataaggcagcgtactcatgggttccaggaattagggtatgggcatctccagggggcctcattcagcctcaagctagttttcagccttttgcatagtcattttgtatttttgccactgtatctttgggggagattcccaggcatgggttggctggatcacaaggcaaatgcacatgtaaacttcccagacattgccaaatccctcttctgcagatggtaacatgttgcattcccagcagcaacatgtatatattttttgccatgcaaaaaaaaaaaaaaaattgaagtctaatttatgactcctttcttgcatgcctctggtttttgaatcataggcagaaaggttttccccactttcaggttctaaaggaacccaaccaattttctggtttcatttttacatttagaactccatccatttggaactggttcttgtatatggagtgaggtatgaatccattttcatcattttgcaaatagctacgtaattgcctcagtgccatttattaaaatgaccattttttttcctgatttgtaacattaaattctcatacgcactttggtctatttctgaacttttcattctgttctattagcctggttattcatgcactaattccacattgtttacttagagaggctttaaactatgctttaatatctggtgaggcctgcttccccataaccaatgtgtgtgcacagacacacacgcgcgcacacacacacacacacacgcattgcttgactttcttaggattttcccggccactcttgtggacatctgatggtgttgaatctttctgttcaggatcatgctacctcttttcacttgtttaaatctacttttctcagctgttttctcttggagaagcactgggctctctaatcctgccttcacctgctctcaaaaaggcaggaaaatgaggggcgatcaatatacctcaaaagctgtaatgtgaagaatacgggctttgagtcagacagacctggttccccccttttttagcacccctgtttcccagctctgtagacgtgcttcttaacttctttgtgagcctgaatttccatctggagaatggggtcagtagtaccatctgcaaggttgtcatgaggattaactcacgtatggctattttaaatgatattttctgcctgtgttgtttgcataggggaacacaattgatttttaaatatttttgtttctttaataaattcttctgtgttctaagtgctttcacaactatgaacacgtttaattctcataatggctctctggtggctgttataaccccgtgtcacagatgagacatcaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggttttttttttttaaagcataaataaatttaattgcatcagactattttctcatctattgagctgctcatttggtttttctgatttcatctgttggtaaggtggttcacactgcccttctgtttcactattccggagctcctgagacagaagcaatttggtcttgatgtttgttttgtttggggttgagattgttgtatccatgttcataagtgaacttggccttttctggttgtagatttggcctgggttttaagatcgatagtgtattttctcaccagttttcataaacacagtttggattgagcttgtgttccttagccctcaggcagaggactctcgtgggcatctgcacaatgaggtcactcaggcggaggtgagacccttgtgggcatctgcacaatgaggcccctcagagggaggtgagaccctccctcaggtggaggtgagacccttgtgggcatctgcacaatgaggcccctcagatggaggtgagactctccctcaggtggaggtgagaccctccctcaggcggaggtaagaccctctctcaggcggaggtgagaccctccctcaggcggaggtgagaccctccttcaggtggaggtgcgaccctcgtgggcatctgcaggatgaggtctctcaggtggaggtgagaccctccctcaagtggaggtgagaccctcatgggcatctgcacagggtgctcagtgcctcccaatcctgccacacgttgtgggtgtggaggcgcccagaccccgactcagttcatcagaacccctggggcagaggctgcagcactcttccatttgtgaggcttggaaatgacagatctgcatctccgctgagggtcccgcctcagggggcctctgtgctgggccttggaggcaagatgtgctcaggcagcctgtcccgggctgctattctccagcagttcagaggttttagtgctccagggaagaatgaacggggcaagcttcctgccttccccatcgtgggcttgccccttccccaggcctgtgttggttgcacacctccctgggctgtctctgagtgtccagggcagggaagctccgtcacgtggagcccacgtgtgggtgactccctggggctgcctgactcctgggccagctcacagcctgcagccagtggttaaacatttcatgtggaatttccaattcccttgaagggtaatctttccctttgatttcaaaagtgttttagaaactatagacaagccttaagaatcctacagagaattcccctccacccaaaggcctcatccatgatttgcccagttttccccaaaagccctcggtaacaaaaggctccactccaggacatgggctgcacccagtggtctcctgtgatctcagttatttcttgacttctgtgaccttgacaattttgaagactacaggccggttatttccctgattcccctcaatttggatttatcccagtgtctttaggagtcgtcctaggtgacgcatttttggccagaatgtgggggaagtgatgctgggcacctcctgctacaccttgttgggtttgacttggccttggcatgtcccgttgttagtccagttattttgctaacttgactgagatttctcccctctaaaatgaccgccacttctgcaccacccactttacaattaatcagtattttgtgagaagatactttgagattctttaaaaacctcatttctctttccagtctcatccaccagtttgtcatccattaatatttcttgctggaattaattagggcaatgagggcaccagtgattttttaaaaattcaatcatttcttctacatttatccattggcctattcctgaaagcaaaagctttctcctcatttatttttccattaattatcatcagtgtggactcatgactttttattttgggtaacagattttaacccattgctatcattgctaattttgatgctcaaacttccctccatttggcgatttgggggtggcggggagcccatccagctggcttctgtattcttttgatgtctccatcattctttgagcacttccttatcttctggcacaagatgttcccaactcatcttgttctttctctcttctttcccagccatttctccagggaaccttgggttagtgcagtggagagtgggatttagaaaccaagatccaggcagtagtgtgctcattgctactggggcatcactgctcccagctaggaaatgtacatatatctatagctaggtcagtttctatatctagccacacatactgaaaagcattatttcacactatcacctccaaatacaatgcaaaaccctcagtttatgtgagcttcccttttctacatctatccgagcccttctctggctcccagtatgctcagtatatttatttttttgctgaattccactctatgtggccagtcttatgatcaaagtgggctgctgccctgcttggacaccattctgcttggatgccttctttgcccagatcctgacccctgactggactctttcactgctgcccttaaaatttttgcatataaactgaagttatcaaagtctaacatgactgcactatcttctttccaggacttaagtacaggacttaaaaattcctgaagtccagtcaagtcatacttgttatatgtccagcacatcaactctgcctcacttttctatatctacaaaggcaatgatccttactggggcattctgtctcacagtgagtgctggcttagatttctccacatttgccattttcttttcttttcttttttttttttttttttttttgtttgagacagagtctcactctgtcacccaggctggagtgcagcatcaggatctgggctcactgcaacctccacctcccaggttcaaatgattctcatgcctcagcttcctgagtaactgggatgataggcacgtaccaccacacctggctaatttttgtatttttggtagagatggggttttaccatgttggccaggctggtctcaaactcctgacctcaggtgatccacccacctcagcctccaaagtgctaggattacaggcgtgagccactgcaccctgccaacagcaaggtatgcttttaacaatgatgaatgagcaggcatctctttaaacaccttctgagggtgtttcactggcaggccagtgtagataagagctgctgttcagccttctacagactcaagcagaatatactccaaccctctacatcaccagccaacacctttacagctccgtccagggaaagaacagttctgcagccccctcttctcattcttaatgccggaattctggccacacgttcttctggggaactccacactgcttctctccacgtgccaccttcctggccttcatcacattccatggatcatctctgactcatcccccaggaaagacatcgtgacaagcagcgagcagaacaaaaccgtcgggcgtgtagacacaagcagcacaggctttgggatcacagcgacagggcccggaatcccagctccatcactttctagctgtgaggctttagggaagtcttttaggtcatgttctttagccataaagccctaataacagtgcctgtctcacgggtgattgagagaactagaacatggtgttacattgacttctgctttctgtcaagcttgagcaactttacgaatgcatctcctctgagaaacctgccagcccctgaggctgtctgtggctctgtcccagcctccctctgtgctcgcctaccccctgtcccgtggtcctcccaggacgcctggttctcattccccagccacttctctgagaatgtcccatgggctccctggtccaggcaggctccagaggcacccatgaagcccagctgtcctaaactccaggcagcggggcccttgaggctgtgactagtatagatgaggcctctggggcctcctatacctcaccccctttgaatgggatgcaagacaaacccaggccttctctgctgtagggagactccagggctgcctctcacagcctctcacccgggaagcggttgttgactcctagtctgtgcctggccctgggctagaatttggggaggagaaagactccggagcacatggtctagatacaaagtcattaatcacatagaagccagggaggtgatgtcagagaggtctgctggggcgccgggaggacactgaggaaggaacaatagaacccatcagttgggtgtggagggcccaggaaggtcctaacagccaagccccgtctcgaggctctgtgaacgtgagcccaggcggagagcagcagagcagggcagggacgaaagctcccaccacaacactctctgccagaagagtgttcacgtttcttccctttcatctacttttcaattgtatcttctttgcagaaaagtttcctttagatgctaaccatttttaaaagtgcaccaagaaggttttattacttagagttaccttcagtgaattatggaatgaaggatcctaatcattggaggaacccattgaaaggccctataataagttgatgctcagatgtgggttgccaaaaaaaaaagcagcagcttttataggtatttctggctcagtaatgctttgcttaattagtaacctttgactgtagagtgagcaaaacatctctttgagcatttttatggtgcaccataaaagggagaatgcaaatgttatatgttttcatttgccactcctgtttgtctgctcagttacctctgtaaacccctgccattcgcagccatttgctgtgctctaatagccaaaataacgtctagtcttctcaaaagcctgccctgagcagagttttccataatgaagatgctagtggtaacactttaggtacagctaaaactgttttcattctgaaaatggaaagcaaaaaaaaaaaaaaaaaaaaaaaaagtcccacttagtgcttatttgtgcataatagtagccattttcttagaagaaactgttttagaaagtgttatgggctaataaagcacaagtctgtttagtgctggtctctctgtaactaaagagtagtggagatggagcagccgggcgcccaggcgtccccaggacgcttagagacgccgaggctgccggcggcgtcgacagcgacagcgtttggaatgacgcatgcctcggtgaagtcgggggcgtgaagcaacactgtctctctcctaagcacacgctgtgccgagggaccggatcctgggctgatggatgggaggccacgggctgtgtttcattttgctgtttgctgaggcactcacctgcgaggacaccttgcaggatgtatggggctttctgtttctctagcacgtccttggtccaaagcctcttgcgatacacctctcccagaggtgaatcctggggaaaatgtcgtctcagcagatgagtgtatctgctttccctagtcagaagttgaagcccatacaatccgggggcagtcccctttttgcctaaacggccagggtggttttttttgtgttttttgctttttttgagacggactctcattccgttgcccaggctggagtgcagtgatgtgatctcagctcactgcaacctccgccttgtaggttcaagcgattctcctgcctcagcctcccgagtagagtggctgggattacaggcacctgccaccacacccagctaatttttgtatttgtagtagagagggggttttgccatgttgtccaggctggtctcaaactcctgacctcaaatgatccacccacctcggcctcccaaagtgctggtattataggtgtgagccaccgcgcccggcccagccgggggtttgaaagccaaatggattgccctggaattccggggtgggattgcccttccacagaacttgcttctgctctactcacccctccaatccccatgtgctgacattcgctgtggtccagtgctgtgctaggcacaggggcctctgaggaaagtacaaggagaacctgccttcagtgagtaggaaagagagactcaggaaagaagcaagataccaagacctcatggcaggtggccatgcctcagagggagaagcaaaggaccgggacctcagaggaggtttcctttattgttatcaaaccggacttgtggacctccctggcacagcaaagccaaaccattgacatcgggattgcagcgagagaaagtgaggtgtgtctttcagggcaccaggccaggagaatcgggtcactcaagcctaagacctgacctctcctatggcttacagtaaggatccataaaggcagagaggcagaggcttcaggcagagtcaagcatcaggacacggaggtgacacattggttttacctaaaaggacatcttaaagcaggaacccacaggttataggtaaattcaaagattttctgatctgtgatcggttaaggaggtgaagctttgtcgaaacattttggatcagcagaaaagaacgttagctctggcctgagggtgtgacttcctccaggctccttaggaagaaatttagaacaaacagcagaggtcagagttccatcctcagctcctccatatctgaggtcttcctcacctcccccacatctgagctcttcctcagctcccccacatctgagctcttcctcagctcccccacatctgagctcttcctcagctcccccacatctgagctcttcctcagctcccccacatctgagctcttcctcagctcccccatatctgaggtcttcctcagctcccccacatctgagctcttcctcagctcccccatatctgagctcttcctcagctcccccacacctgaggtctatgtgtagcggacctgcatagccaacccatttggtgggagtccgggtttctgaaaaacaactcagggacatatggtaagatgtcactttagtttctattgggaaccaagcatctcctgactctggcttccttggctattgttttcagctactttcaccttcttgtttgtcaagttgctcctttatttatttatttttaatttttatttatttatttatttttttccgagacggagtctcgctctgtctcacaggctggagtgcagtggcgcgatctcagctcactgcaacctccacctcctgggttcaagcgattctgctgcctcagcctcccaagtagctgggattgcaggcactcgccaccacacctggctaattttttgtatttttagtagagatggggtttcgccgtgtgggccaggctggtctcgaacttttgacctcaggtgatctgcccgcttcggcctcccaaagtgctggcattacaggtgtgagccaccacgcccagcctcgctcatttacttctcagggctagctaggtgcctggaatttcccttgaaggaactcaagatttttctttatttccatgtttgggggcccaccagtccctaagaggggttcctgctccatctcattatgaggatcttccttggaaaataggcagtgtggacatgtgggtagaaacctgtcctgaaatgtagctgtaaagcgtccactttcctgtgcatgtcttctctgtgatttgctttcctctcttcaaaagtccacagtgtttataagcacatcaggcaatgtcaaggcttagaaatcccagagtctcctggaataagacactcagatcccctcactctacctttactgctgccagcattccgtctggaaccaggcctggctgtggcagggcagagccagctctgggacctgcatggatttgtgtggccacaggcaaggccaggggaaggtgaagttattacctggtaaaaccagcagaagagaggaactttaggcaccttagcaacgagccaccctcccggcaatggttgttaggggtgtgggggatggtcactgagagctggctggttggcagaggatggagaacagaggctaggggccaactataccgggatgggtcgtgggacctctgtaagcctcagtttcttcatcataaaattcagagaccagaagttcatttaacgctttagcatgggactagcacatattagacatttaataaatggaagttcctaataataaaaataatgaagttaaggcaagtgtttagcatccaagaaggctgcttgagacactgtgaccttcagaggaaagacctccttccccagagggaggcctgtggagtgtgcagggccctgtcctagaaaatacctgggaaaccaagcagaggccagcagggcaggttcaggcaagatgagcgccacataggagctgagattcaggggccggggacactgaaacccccacgggggtcgctgtggtcagagaacccaggtctgcgaagtccccagtgactgtaaggatctgtagcccaggaagaggcagcctgggctcaaacacccacagtggcagtggagagtcaggctggagctactcacagtgcactcgagcagaatcacaaactcgcacagcttgaaaatggcaaatgcagcagtccccagctctttttcccggtagaaactgactttaggaacagcaaggaggcttctcacccagcacactggttcccaggcttcacccagctgggcagagggtcaggagcagcccatctctgcagaggcattggcctgttcctgccccaccccacctcgcagcaaacaaagatggcaagacggcctgggccgactctgggtgaggggctcacctgggtcaggaagcagacagctcctgtacggccaggggctctcaggttgctgtgtttggtacagtaacgtcctgtatttattttttatgtggttaccatctttgtcctcccaggaacacaagctcagtgagagcagggactttgtctgagcagtgccgcatctccccttggcacccagaacagggcctgctgcatagaaggaaggcgtcatgccaggaagcgcctgtgagcaggtggacagggcatcgcacacatgccatccgggacagacatagccccagacagatatattgggccgcccaaggcccaataaagtttccaaccttgattgacttcactgtccacctggccacctgttacctctgtagggagaaattctagtgtgcccgtctcctgcaggttcataagccaaatgcttttatctcatcacttcaagatctggggctggggatttctcatcactacttctgtctcctccttccctccttatggaaggacgtgagacctgtctgtggccctttggataagtatctgtcagcatttcggtcataataaaccctgactgtagttgaatttctttttcataataggaggaacaagagtgacattatctctgaatagtcattcgcacatgcacaggagagctgtcattggccctaatgactccttccataatcccacggtcatctggtaaatttgccgaaacgggcctcattttttgttctggtgtaatgtctctgcctaagcgtttaggtgctggggagacaggtgacaatgacatacatactcagaaatctcagaatgtttcttggttgctcgactgtccataataacaccctcacagtggcttttctctcttatttctcaaccagcatacaaaatctatatgagatgaatggtggaaaaggggcctttttgttcattcatctgtcagatccgttgaggtcctattatgggacctttaaaactaccacaggagaggaaaatactgccgcatacgtgacaactcaagtgggaccaaaggaagtgttttaccacaaatgtcattttcgaaaaatagaggtcaacgtatatataaatcacaaccgtcaaaccaaattaaattttatgagactcatatttccccgttctttccgaggaccattccctgctccgattccttcatcctaattctcttgttggatttttttagatttgcctgtgtgtttcatttttccagccattaggttttatatttctttccttcattcgcccattcacccagcagacacttattaagcacctactgttttatagattttattgttccaggtatcgtgctacagattagattactaaggtcaaaaccttttagtttctccctccgagaattcacaattttcaggaggagggatgtgagagggaggatggaaatgtactcggttttttcttttttttgttttgagatagggtctcgctctgtcacccaggctggagtgcagtggcacaatcttggctcactgcagcctcaacctcccaagctcaagcaattctcccacctcagcctcccgagtagctgggattacaggagcacaccacaatgcccttttttttttttttttttttttttttttggcagagatggggtctccctatgtggccctggctggtctcaaattcctgagctcaagcgatcctcctgccccagcctcccaaagtgctgggattacaggtgtgagctactgtgcccggccacaaatgtagtctaaattttggtacacatgagagtcgtgagaattgttgtaatgatctatggccaggggagtatgtgaaagcaaatgagtgagcagggtcagccaggaaggctctgcagaggaggtgagactcaggttggaccttgaaggggacacagtctttcgatgggagggaagacattccaggcacagagaagagaggaatgaaaggctcagggttagaaagttgcacagcacctgtcgttttaaagtatagatcttatttttattcgggaacggtgatgccaacagatcgagagacaaatggcattggaaagacagtttgttgctgacagatcccaaggggagggggcagggaatgccacacagggccatgtgcagaagcaccgggtgggtcaggaggcagaggaggaggggactgtggcaggagcctctgctgtggcttctgagggaagggccgggccaggcaaggttaggactgcctggtgtcacagtctcagcgggctccggggctgggggctgttcctgctgtcagatgcccagccccagtgacaggacagaggcatgaagccctgagtgtgagcgctcacagaggatgaggtgggactgggctctaggtacaaaaggtactacctccaggtgagctgcttgctgtctctgggaactggctcaccctgggagggccatctctccagggccagccaggcccaggtgtgccaggtccagtggaagtggtggctaatgcaccgtgggcagggccaagcaggcacagagtggggcgtgtgtgagcgggatgtgatgggagatggcccaaggggagccgcagctggtgggaaaggccatgcttgggggctggcttgtttttatctaaaagcacccctaagaaaccgtggctgctggtcaccgagctcgctggcatgtgccggagtgtccggggctgacctcgtcccactgggggctcttgacagccctttagggtgaccactgtggtcctcgctatgtggacaggaagtctcaggagctcagtgtctctcgaacgtaggcccagccaggcctcatgccccagagattttggccgaggagccactgctgctctcctcacgccccttcctgggcaacggagcagaagtcctcaccagcgtttcaggaatttagaaatattagcagggaatcacccaacatgtggcacagggagtgtcaacgtccctgtttccccttgagagggatcagatctgatgggagggagggacagatgcggatggggaggttgcaggactcagctcagacacggccctgggctcctagggcaggggccatggggggcagacatggcctccaggagaagggctttatgaaggagctggttccttcagggcatggggttgagcgggaaggctgtttcgggggacacacttgggagatgtgaacaaactggccagaatgcagagagcacagggggagctaaggcaggcaccaggcgctgtggactgagcgtgcccccaattcctgtgctgaaatcctcacccccaaggcgagggtgtcagcaggcctttaggaggggatggggtcatggggtggagccctcaccaatgcgatgagtgcccctctccttccaccacgtgaggacacaggggcatttggccatccccagcctggaagggagtcctcaccaggacccacccaggctgaccccctggtcccttcagtcccagcgctgtgaggaaatgaactcccattgcttgtaaaccacccagtctgtggagtgtcatcacagtcgcctagtggggaaggtggtgtaggagggcaccaggcacccctgggcctggagagggaggctggaccgctcggcacagcaagagccgtgaattggagtcgggtgagatggatgagctgggggcctgtgggttaacaaggaccccagactcatctgcccctccttccctgtggctgtgagccccaaggtccacaacaccctgaggcctgccccaggctgaaccctgcagggtgcgtgacgggggaagggaggcctatgcggaggtgcacacaggggtctcctttaggccagtgctctccgcactggttgccagagaggccgccttgcctgggccccgaaaaccaacagctgggcagccctgaccctttggtttgtttgttttaaggtagcaaggacacttgcatttttttttttttttttgagacggagtctcgctctgtcacccaggctggagtgcagtggtgcgatctcggcaagctccgcctcccgggttcacaccattctcctgcctcagcctcctgaatagctgggactacaggtgcccgccaccacaccacgcccggctaattttttgtgtttttagtagagacgggagtttcaccgtgttagccaggatggtctcgatctcctgacctcatgatccacccgccttggcctcccaaagtgctgggattacaggcgtgagccaccgcacccggcggaaaaatttgcattttttaaaactcaccgatctgtcaaaatagttcaagcaagaggttgggagcttctacatcagggtcctaccactgaaatcaagcaaatgtaagagaggctgtggaggagaccccaccatgtgcagcaggggaggggtgacagaaggagcactgaccctcgatgacagaggacgatggtgtcgtgaccagaaatagagccttccacaggcggagcccgtcttgggaggaagatcgcggttctggggtgaggctgtcacatgtgagctgctggaccccagaagcgtctgcctgtggtcggtaggaaggaggtcccgcacccaggtctctgtctccttgtggagggacaggaagggccctaggaaggaagccatgcaagagagaagaaagaggaggcaaggacacactcaggagggtcagagaaagggccagatggggagtggagggagatcgagagagccagcaccccaggaacccaagcatggagctcaggatcagggaacaaagcccatcactccacagcccttctgcctctgaagatccaaagaatattaaacaggaaagacaaaacaaacgacaacccggaaagacagaagtccccagggaagggctgggaatctagagctgggctgattcaaagcctgaagcttccttgggagtgaagataaacgcagcacagcgtcgagtcccctgccggcttatgaggtgtgcaaactctgcgatttgtttgagggaactggcctctgggccttcctggtttcctgtgcctttaccagaagcccccatctgtccctccctctgcaggggccctccagccacctcctctcaggaggtttcatttggctgtggtgggcacggggaggagccgtcagaagcaggggtactcagtgtctgtggaagttgctagacgtgcaagttttcctgctgacaccagagtttcagccaggcagggtgcgcttggcttggcagctttccatggaaggggttctggagcatctttttctcctcctcttagctctggatggaggggggccacctcctcacgtccctcctcccttccccacacgcagctgcaccttgtctgcttcctctccatgtgcagaattacctttgggatgaggttaatgactctcctctgagcagccattgaccctggcctccggagtgctgagctcaccatggccaccagagcctcccagcaggggtgttcctggtcctgccctgcccaccagtttccaccagtttttccagaggccggatctcatgtgcacaaacagaccaagcctcctggcccactggcgccaaaccccggccagacctgggagtgggcaagctggggctgcgtggcgggcggcagcatccccgtgggtataacagacagacagctcccctaatgggcctgaaggaccgcccctaccgggtggcatttgaaatagatgccatttctgcctttgtccgaaatatcataaagtactgtttattagccttaaaaaaagttaaaaaaaaaaaaaaaaaaaaaagccgttcaaaatcccggcttccccacagagcttttttttttggagacagagtctcactctgtcacccaggctggagtgtagtggtgcgatctcggctcactgcaagctccgcctgccgggctcacgccattctcctgcctcagcctccagagtagctgggactacaggcgcccgccaccacgtccagagaattttttgtatttttagtggagactgggtttcaccatgttagccaggatggtctcaatctcctgaccttgtgatccaccttcttcggcctcccaaagtgctgggattacaggcgtgagccaccgcgcccggccccccacagagctttgatttgttttatctttaaagaattctgcctccctctacatcagcacattgttagtgagcacccagttgcttctagaacattctttcttggccttgaaatctaactagagagccagaggagcccagccagggttaaagaactcctgtctctcacgaaaaaagagtcctggtctctccagacaaaaatgtaaaccttttattatagaaatttcagtttctcccctagaggtcgctaagtgtagttacatttttggtgatcatctgttttggagctccgtgtaaagcaacccattttcagtactgatttttaaatcattcgcatgttcatttgtaaattcgttaatgcattaaacaccaagttgaggctggaccctgggagagatgctggaggtgcagggatgcgtgagaccctgaccttgcctcagggcaagtccacaagcagccagaagtgatgacacatgtggtgagaggactcagcagccgaggaggagtcagtgccgtgggggtggtgcgctccagcagggcttgccacactttctgtaaaggtcccgatagtgaatacttgaggctttccaggtcagacgctctcagttccagctccgcagttcggctgcaaaagcatgaaagtggccagcagccgcacaaaccagtgacagtggctgtgttccaataaaactttatttacaaaaacaggaagtgggccagattcggcccctgggccggagtttgctgactgcagtactagagccctgcttgtttgtgtttgagacggggtctccctctgtggcccatgctggagtgcagttgcataatcaccactcactgcagcctagaccctcagagctcaagcgatcctcctgcctcagcctccagagtagctgggactacaggcatgcaccaccacacctagctagattttgtatgttttatagagaatggggtctcaccacgttgcccaggctggtctcgaagtcctggactcaagcaaacctcccgctttggcctcctacagtgctgggattataggcgtgagccactgaacctggcctagagcctgctttaataaacctgctaggggccatcacgttaaagaaggtaattgtgtttgacttactgtttgttgatttggcccagactctgtgaagttggatgctacctcatagaagattgtaagttgcaaagccagaggtcacggttatattgctctcatagctggttttatttctaactttttgatcttattgagcattctttctttcattcactctacatactttgacatatattcccctccgaaccagttttaccatcttactagttcctcattaatgagtgaaataaatctttgacacacactatatatttgtatgagaatttgtatgcatgtatgtatttatttatttatttttgaggcagggtctcactctgtcatccaggctggagtgcagtggtgtgatcatagctactgcagccttgacatcctgggcgctaatgatccccctgcatcagcctcctgagtagctggaactatgggctgtgccaccatgcctggctaattttttttttaattattttgtagagatggggtctccctctgttgcccaggctgattttgaactcctgggctcaagagatcctcctgccatgtctcccaggagctgtgtttttatttatttatttattcttttgagatgaagtcgcactctgtcaccctggctggtgtggagaggcacaatctcagctcacagcaacctccacctcccaagttcaagcaattctcctgcctcagcctcccaagtagctgggattacaggcatgtgccaccatgcccagctaatttttgtatttttagcagagacggggtttcaccatgttagccaggctgatcttgaactcctgacctccggtgatccacttgccttggtctcccaaagtgctgggattacaggtgtgagccaccgcgcctggccaggagttatattttttgttttttgtttgttcgtttgtttgttttagatggaccttcactctgtcgccaggctggagtgcagtggcatgatctcagctcactgcatcctccacccccctggttcaagcgattctcctgcctcagcctcgtgagtagctgggactacaggcacgtgccaccacacccagccaatttttgtatttttagtagagatggggtttcaccatgttggccaggctggtcttgatctcttgacctcgtgatccacccacctcagcctcccaaagtgctgggattacaggcgtgagccaccacgcctggcctgggagttgtgtttttaaatgaatgctttgacagtgatctgcactgtgctgggggtactctgaagagggtataggagtacagaattaggacatagattctggcagcctggcaggggcagtgagaggctaagagggatgctgttcagaggcttccgaaaggcccggatgctctccagattccaaaggagtcagccagttgcagagaggaggggtggaaggagcagacacactctgagagggggaagagtggtgcagggggacaggtgttggagactgcgtgatgcctccaggtaatgacaaaccgcggctgcaggaggaagtgcaggcagagcctaatggagccatgtggcacctgcctgggttccccaatcatttggcacctgttccaatcgacatctttcaaaaagggagaccaggcactgggcgggaagggcagggtagtttgaccttggctgccaccttcagtggtccacccttttcccaatccattgatcctggccctgaaactgttttatgctcagcaaaacaacagccctgtagataaccagacactcgctgctcagaaggcaggtgagggggtcatctcatggagaatggccacagggcctagcaatggctccctcctcaggctctcctggtgggaaaggatgaagtgaagtggagatcagccgccccactgtcccccgtttcttttttttctttcttttttttttttttgagacggagcctcattctgtcacccagcctggagtgcagtggcatgatctcagctcactgtaagctctgcctcctgggttcatgccattctcctgcctcagcctcccaagtagctgggtctacaggcacccaccaccacgccttttttgtatttttaggaaagacagggtttcaccatgttggccaggatggtctcaatctcctgaccttgtgatccacccacctcgacctcccaaagtgctgggattacaggcgtgagccaccgcgcccggccagcccccgtttgtgaccgtgcagtggtttcccagcatctctgcagagggagccgcacgcccggcgttctcagagaaacccgatgagcctggctgcctcttgctgtgctttcccccactctcctgctctctcaacgcggcgcgtgcctttctctcccgggcagcctcccgggccttactggttctctttcgttcctcttggtcgtgggggtggaacagccctgaatcccagagctactgccctgaccaccgctgaccccgcagcagcccctgtggctgagagcctgccctgagtgcccagtgcctgaacaagatgagggagcccacagggtcaggaagcccccaggcctcaggtgaatgcttctggggccaggaaagcagccagacagactgaatccatacatgccgagcatccaggccagaggagggcagggagctctaggcagagcccccgcccaggaccccagcgttcctcagtcttgtttatttctccctcaggcagccgaatacacacatccagggtggggagggtggggagggtggggagggtggggagggtggggagggtggggctgcaggggccaaccagaggaaggagacctggagtcgcttagcaaaggtgaatgagcgtccgcagtgcagcttggggtcttgagagtaagttgaacccgccaggcgtctgtttccccctcacacatgcacagaccaggcaaggacccggaaggcaggaggctgccgggaaaagcgcccaccggtcacttggcaccgtgagctacgcacgtgagccacgtgcgccctgactgctggctctttccttagtgcttatacgtgattgataaaaggtgctaaattgacggcctgaaatggaagtcatccctttttcttcctttcttcttcttttttttttaaacaaacaaaacgtattctccatgaaatcgcccagtgctttggtttaacacccagaggactggtttcactaagaggagcccacctaagtcaccgaggactctgaaaccgctaaaccatgccacagggccagcattcaacacggaggcactttgcacccagtaaaatccaactgaaaaaatgtggggcttggtcctccgcactccccagtatctggtcccagcccgcctacgacccccatctcctcccctgagacattgcccaggcagccgggggcctcccacggaagcctgagcagctcgtcttgcttgcccttccctctgtgctgtggtgcgtgttctccattacctggaggcctgtaaggtgtcgtgagctgtgccgatgtgtgacaaacatttggtgaccttgaatgaatcactctttttctgggcctcagcttctttcagcgtaacataggctggaataatatcctccggcttcctagcttatgggtgggcccatttatgcatcagctgcatagataaatatcgcacggctcctctccactagacactgtgccggggccagagctttcaagccaacctgagtgagctcctctgagatccccggatcgtgaagttcattctctttttgcccatcaggattggatggttccagtctcagcattgtgctcctgggtcctttccctcttcacagacgcgatggaggaaggcagctgccatgggccctgatgggggatagggaggcctcagtcctgtctgactcaagagctagtccaaccccaggttcgcctagacccttcccttctccaagatgagtgttctgtggaaccttaatctatccacataactcttgttttctgtgtctctgaagtgaggatttgagggtttcgatggctaccccagtgctgagaactggctcactttggctgaagtgaggatatgagggttttgatgtctaccccagtgctgagaactggctcactttggtgccaggggacttgccccctttgcctctggctgtgcaagctgcacagtcttttcctaattacaccaccctgtggttttgccgacttccggggtattcattatctacgctgacctccagctcgttctctaccaaatattttggccggtcattctacatttcattttattgtttctttttttcgttgaggtgaaattcacctcacataaaattaaccattttaaagaataccattcacaacttagtagattcccagtgctgtgcaaccaccacatctgtctagttccaaaacatttttatcatgccacaaagagacctcatacccaatagcagtcacttcccatcccctcctctccccatcccctggcaaccaccaacctgcgttctgtctcaatggatggaaagatcctggacatttcgtaaactggaatcgtgcggtgcatggaccttgggtcaggcttgcttagctttccatcagtcatgttttgagatttgtccatgtggtagcaggtgtgggtgctttgttcctttctatggctgaatcctgttccatggtgcagagtccttttgtttatccactcagtgctgggcgtttgccttgttcacggctttgactgtcgtgactagtgcactaggagcatgtgcctgcaggtatctgttaagacacctgttgtctgttctcttgggtcagtggctgggggcggagttgctggcttatgcggtgactgtgtgtagcttttggaggagccactgaccatgtggatgttttcagctgaaagcgttgagagttttgcgctttgcctttcgagttctctaggaagcaagccaccagcatgcctgcttacacagtctcctctgcatccgtgtcgccagtttaccaaggtcattttgaattctcctgccaccctcccaagacttagccacccaccaccttggtttcctctgcacacttagtgagcacgtttcctatcctgtcatttaagccacttacgaagtgttaaatgcaccaggccccaggccaatcccactccagcagccagtttgtcctgacatgctctccatgcttgcagccggccttctctgtgtcccttgggtcccccagagccacacggccacacgaaaccagagtttgcttgtgatggggctgcagagatctccaaagatgagctccagggctctcctggtgggcacaaggccgtggctgtctctcccgtggctccctagctggcgcagcttgtgtggcaccatcaagggggagagagggacgtggtcagcttggggcagtggcagtagaagcggcactggcactcgggtttcttaagagcacaaggatgagtgagaggtggggctcggggtcagattaggggaaatgaaaatgctactgagcagggagatggtgtggagctcccagacagggagtaaaattagcacgagacagaccatggggcaggagcaaagactcgggagaggaagaagctggggaacttggagggcaccctgcaggcatcgccagcagacccggaaaaggcaagtctctgttgaagggagtggctcttccctcgtcaacactgccaggaggcagtttctttaaatcttaaggggactgggcctgccgatctggcttccagggcagaagactcatccttccctgcctaaggaccttccttatgccgtgggccagcaatggtgtctgtttggtgtgtgtttggggcagaaagggttggggtcgaagctggacccccagcctgtgcccacagctctgtcactgcttaccatggtcctggccaagtcttcctctctaggctttctctgagccctcacttgtcaaacaggaggaaggatgagatggtatggaaggtcccctccatcactgatggcctccaagccctcagaggtttgttcccaggggtttcactgtttgggtccagtccttctgtggcccagttcttgactgtgagcttttgactaaaactcacccagacttgatggtgggcatagcaagagcctgtatctccaaggcacaagagggggttgtgcaggactcaacttgtcccaggtgtggggacgccttgcagccctgcccagctcaccaggtaccagcaggtgcacatggtctacatggcagcctcagtccctaaggcatgtccagcccatctcagtgtctccctctgcacaggtgggagctatcggcgacgaggaggagtgggtcaccctctatgaagaggagaatgagcctgatgcccagatgctggagatcccaaacctcacaccctacactcactacaggtgagaacagcagtgataagctgttacaggaggaaacactggcagcccaggcaggtgccttctgttggcaatagtaaaacccagtcgtacgtatgcaaatcagatgtttcctagtggcaataacagtacctaaaagccttaaggagcaggcgggatgcatagcttggtgttattccaagggagatgataggcagatgttagactcatgaggctccttctatcagtaccagctggcaaaacaccccatagaaatggcccactgttattatattaggctgaataaccaagaaccacaggcagcagagatgtggcactttaccaaactccacaacctgttgggactattaacgtgccgtgtgcaaacaaagcagatgtcctaggaagatccttctgctccccttcccaagcagggcccaggagctgctagtctcacttatcaagcaattaacatgccatttaacctttagcttcttgaaccccgaaactgatccgggcagtaaatccttggctttaacaaagggtagggtgattatgagctgttagtactgtgatcacttcccgtaaggcctttgaaggagatggaatttccagttatcaccagatgttgagtttgataatgtcattgttctgccaggatggaacatttcatacgattggagaatgaaagaataggaattagtaattcagggactaaaaggtgaaattacatctttatgaagaatttttctttccggcacaaaaccaaagttagagttaaaaaaaaaaaacaatgagagatgctatttagcttctattcattttaacatccttcaggagcttagaacagacaaatcaggacacaatacactgggttttaaagaaaaacatttagcttaaaatgagctgttgggattcaagacttaccatgtgaaattaactgaagctatatagttatttcaaagaacagaaactgtaagtagagatcagtgtccctgtctgaaactcaggtacatttggggaaacctctatagtaaatgtatatgtgcatacttgggatatttttctagtatgtaaattgaattcaaataattgtttatgtatgtgtaaagaagagacagaactgaaagcattcctgtagattttagagaacattgaactccaccttcattttatagttaaggaaacggagatcatctgatttgctgtaagtctcacagttactcactggatggaatcacagagtgtggtgtgagcggatagaggcctcagttacctgacaaagtttattctgccaaggttgaggatgcacccgtgacccagcatcaggagatcctggcaacatgtgcccaaggtggtcagggcacagcttgcttttatacattttagggagacatgagacatcaatcaatatatgcaaggtgaacattggttcagtctggaaaggcaggaaagcttgaagcaaaggcaggaagactccaagcagggagggggcttgcaggtcacagataggtgagagacaaagggtcccattcttctgagtttctgatgagcctttccaaaggaggccatcagatctgcattgatctcagtgagcagagggatgactttgaagagaatgagaagcaggtttgccctaacgcagcttgcgttttccttgtagcttagtgatttggggttcaagatattttcctttcacccctcattcttctcctgaaccaacagaagaagagatgcagagtgccgttgatcatttaaaaggctggacttcaaaactgccctttggtagtgacatcctgatattccaattctgtcccatagctacttgcactttaacccctcgaggttatcctaaacttgaatcagggcaactgatgacatcaatttctggacacccaatccatccaactagatttcacttgcaaatttaaaattgttgagttgcaactgatgtacctgtacctttctttgaagtcttttaggggaaaaagggcacatatgcaatttgcattttttttttttctgaggcagagtctcgctctgtcacctaggctggagtgcagtgacaccatctcagctcatgcaacctctgcttccctggttcaagccattctcctgcatcagcctcttgagtagctgggattccaggcacccgccaccacgcctggctaatttttgtatttttagtagagacgagatttcgccatgttggccaggctgatctggaactcttcacctcaggtgatcccccgctgcctcctgcctcagcctccctaagtgctgggatttgatcccccgccaccgcctgccttggcctcccttagtgctaggattacaggtgtgagccaccacacctggccacaatttgcacttttaatgaaaccaggtgaaaagagggtgtccttgagcaatagcctttatgatatgagtagacacctatctgagccctcccttgagaaacagtcagcgcctttgtggtttcgttcttttccttcttacctttgctttgccgtgactctcatcagtggtttttcctttagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtggtgagtgggggtgagaagggaggctggaggcacacgggtcctgagtgagccagggcacacactaatccagggcttaggagtttcttagtcacgcctttgtcctagtcaaaactaatctcatcgtcaaaccaaaaagtattgcattttacaattagtgttggatctcaggccagcccaggagatctgattaattagtagcattactcactctcttcttggaactgaggaatattccttggggcaggaaagctgggggtgcctcacaccagaactctaagtccttaagctaggtcaacatggaaccaatactcaatatttgtaagagagccagcctgatatttaatcagaacatttgcccacaaaattaagccaaaatgtattaaaagaaattatatgcagccaaagttactgacagggtttcatttaattcacagaacaaaagtttcagggaagaataaagtagatccttctaagactatttcccccaggaacacctcctccacggagttggcctcacagggcaggcccatcccttacaacccgtgagggtggcagttctgagatgtcagctcatcgcgactcctcgttccttcctagcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcaggtgaggggaaggcgattcccatcctggagacaccgcattagagatggggctgagtgcccctgagcctccagatcccaggctagtggcgtctcattggcctgtcccacttgtgtctgtcttggagctttcctaatcccgggtttggccagactcggcaggaatttctgtctgatttcattagggccccaagccattcattggaaactggtgatgatttccaacaggggatcgactcacattactgttttctaaattagggataattttcgctaacgatgaaaagcaagaatgtgtaaagttcctatggggaatctttaaaatacaaggtattcaggaccttcttgtcacaaattaatagacgtagtatgttaagtaatctagcctgtggtaataaataggcctctaaaagtttaattgcttgaacataataggagtttacttctcactcatattgtggtctaaggtgggcgttcctgtttggcgggtggctctcttccacaaggtgattcagggacccaggctttaccgttctgtgggactaatctccttctgcacccagctgccagcagggaaaagaaggcaaagaatggacctcttcagacctgttcaggagtggaacgtcactctgttcatcttcttggggctcagtcatggggctctgccagttgccaggaagcaatggagcagtgtttttggccaaccttgagcagacctctgctgccctgtgctaatgctgaaagtggctgcctaatcttctgggctttgtggactaacttccgctggccaactgtgggtcataggagcttttcttgcccccctccttaaatttttagaaacccaaaggaaggacggcaattaacgctcatgaaggactcactgtcacctgaccccggtcccttcagtctgatctgaattagtgaggttctgtctggagaaggaatgaaccagctgcacctctgccccaggcttcttggatgagagtcacagcttgtgcttgacagatggaggggctgttcattctggactaacctaggctgttagaaatacaacttaaattcctgacctttgtccagacatgggatgaggaggaggtatgaagggttgagatggtgaactgggtcagtggccagaggaaaagaacaagactcccccactccttcccccagggagcctagatccattttgcttattgatgtcaaaccctcttattcgctctcttttgcttctcttctctgactctctgcgttaatgagaatatttggctccattgtttttgctgtcgtagacatggctctgtttcctggagacagctcctgagcccagcatgagtcctcctttccttggggctcccagggcacagaatcgctcttgaagctggggagtcaagagatggccagggcctgcccacagctgtttccaccccagagtcctcggaaatgccccggatctgccctctctgcaacccagagcctccctgcttctgtccctgtactacaatgccgtgcaaagagacagtccccctgttgttgttttcagtagaaaaattaattaacttgctagatgctggaaactgccttaggagacacagttggaactcagagtgactttgatgggaaatggacagaaagatgagctaggaagccaagtgcgtgacgggtatcagagaaaacctcgcacagtcagcaggaggaggcggatgacgtgggggcacaaggcctgttggcatgggtggaggtggctttggggggctgccatcctcaggacagaggagtttaaaagggaggaaagcatagacacttggggggcccagggctcccgggcctggcctgtctgctctaaagatgaagagggaaacatagaaggtggtgccgaggtgggagggcagcctctgaggacagctggagtgaggacgcagatcagctcccagcaataaggaaaggggacttggagccctgggcggtgccaccccctcacctcttcctaatgctcatcttatccgtgccaggtgctgcaatgggtgcaggtattcccaacaccacccctccaccctcgagacagccaggccggggtgaggagtctgcaccctgggcttgggtccagcagcgcccagcacaccgagggcaccagcacgtgcccagtgcatctgcacgtgccacccgctctgtgtgccacagcgtggaagggcctgggaagctctggataaaggctcctctcatcctttcttgctcattccccgggtcccgttggtgacaggtctgaacctgccgccacccttgtaggttactgtaatgcacagtgggttgcaatgcacagaagccccctgggtttcctcaatgctggttaactttcagccaccagcaccaagccaaagctcctgtgccactttgtggctttatttcttcctactcttctcagagggcaggaggtgagggtagacaggaggactcttaagcagtagcagggagaagcagaaccatggccttgtgggaatgctgttagggcgtggcgtgaaccctggagcccaccaatgagagccccggaagagcagccgtggtgacaaccagtgtgcttctgagaggaccagtgtttcaggatggaactgcccaagcagcagggctgggcccagtgtccctcggctctccttcagactgaagctttcattacgttccaaaggaaaggtggagacgcacccacatgcagcctgggattgtggtcacgtggatttcaaaaatctctgttatcttcactgtctgaatctttgtgacaaaggagagaacttgagaagttcagagggacagttctaaatccagtaaaaggcaggccaagaaaatagtttttcagaattaaaacttctgccataaccaacaaaaacttatggataaaatataactttctggaatcttaaatgtattggccaggcagggtcctcacacctgtaatcccagcactttgggaagctgagtctggaggatagcttgagtccaggagttcaagaccagcctaggcaacatagtgagaccccatctctacaaaaaatacaaaaattagccaggtgtggtggcatgcacctgtagccccagctccttgggaggctgaggcaggaagatggcttgggcctgggagtttgaggctgcactgagctatgatcgcaccactgcattccagcctggccaacggagcaggttattatgcctctaaaaaataagtaaataaatgaattcatcaacacactcataagaaaaacagggaaatcctcaggtgtcagaggcataacaggaactagaaagagttcagcaggaagtgctgggctggtgccgcagctgccctgggtgggataggatcaggttggatctttcctggtggtttcaggacctggggtaaggagtctgcaccctggtcctgggcccagcagtgcccagcacactgtgggcaccagcacgcatccagtgtgtctgcaggtgccaccgggaactgtagatacactgggcaggccatgcagtaacatgagagtcagctttgaatctgtgtaagggaagagttagggcctaaactcctgcagttgagacacggctcttgaaggcctttccctccttcctaggagaggctgaaactctgcctgcagaggtttgactgtatgtctacctggactctgagtagagaatgaaaagtcagtctgagccctgtgcccagctcaggactgggttttgaatttgcattatatggatggcccaggaactcccagaacagaaattaatgtaacatttggttccagaaaccaaaagcacgagcaactaaagaaaaagtagatacattagacctcatcagaatgaaaacctttatgcttcaaagaatgtcataaaggaaatgaaaaaaactccccaaatggaagaaaatatttgcaaattatgtatctcatgagggatttatatctagaatatataaagacttcacaacaaaaagacaaatgacccagttaaaaactgggcaaaggatcggcatagacattcctcccaaggagatttacaaatggccaccaagcacatgaaaacatgctcaacatcattaactgttagggaaatgcaaatctaagctgcaatgagataccacttcacactcctaaaataagatggctaaaataagaaaagttggacaataacaggtattggtgggcatagagaaattggaatgcttgtacgttgctggtgggaatattaaatgattcagaaacgttggaaaacagttggcattcctcaggaggttgagcagggagtcaccatacgacaaagcaactctactcctaggtatgtacccaagagagcagaaaacatatgtctacacaaaatcttgcacataaatgttcatagcagctttatccatagtagccgaaaagtggaaacaaccaaaatatcactcagttgacaaatggataaataaaatgtggtctatgcattcaatggatgattcagcaataaaaaggaatggaattctgatacatgctacagtgtgggtgaaccttgaaaacattaggctaagtgaaagagaccaggcacaagagaccacatattgtgtgattctatttgtaggaaacatctagaataggcaaatctagagaggcagaaagtaaattcatggtttcctagactaagagagagcatttgagaggaatgggaagtgatgggtgatggaaacagagcttcttttggggatgatgagatgttccaaagttcatcatgatgatggttacacaactctgaattcactaaaaaatgttgaattgtacaatttaggggaattgtatgatatattaataatctcacaataaggctttaaaaaaaaagctcagccttcctgagattaattttatacagataaaatgttattaaaataagtatgggctgggggctgtgattcgtacctgtaatcccaacactttgagaggcagaggcaggaggattaccaggagcttaagaccagcctgggcaacatagcaagaccccatctctacaaaataaaaataaaaactatagaaaattagccaggcatggtagcacatgcctgtagtcccagctacttgggaggctgaggcaggagaactgcttcagcccaggaggtcgagcctgccatgaactacgatcatacccctgcactgcagcctgggtggcagagcaagaccctgtctctaaaaaaaataataagaatggctcatagattgtacactttgcgtatggttggaaggcccagaaaatctgtgtgtaatatcttcttaccctcagggaaaacagtgatcaactcttcctgaaatagttacatatcataccccaataaaggattttactctcctccaaaaataaaacaaaaagaaaatacacaaaaaactaaagaaacatggtttcaggccagaccatctgggcaatcaacagaagcaaaaatgattcctctctggagagatattgccaaagccaaattatccaaaataaaaagcctttttaaagatgaatcacaattgtcaagcacacaggcaatgatttgccatgagtaaaaatgaccagttttaaaaaaagagagaaagatagagggcttcaattacattaacatacatacaagtctgagagaaatatataataactacatttaaaattattaaagtcttagtaaaataaagcgttaacattttaagtaaagattaaggtaccatttcttaaagcagatttgtttttagaaaaaataaatgggacacagtcattgaaaatgaaagcagtttagacactgtcaaaaagagaattaccaaattaaaagctagatttgagtaaataactcttaaaacaacataaagacataagattgaaaatagagattaaaagacttgaagaacagaatgagatctaccacatagctaataggactcgaaagaggaagcaaatgagagttacaaaatacacagagataatagccgagaaattccagggttgatggaaagcattatttacaagactgaagaaacaccaatcccgagtggagtaaataaaactgaattcataccaagatgtatttgctacaactgtaaaatgccaaagagaaaaatcttaaaaacaattggagtgaaaggcaaataatcacaaaggcaagaccatttgactgaggtgactattcaggaacaacagaggccagaagacaatgggataataatctcgaaggagctaaaagcaaataactgccaacctcaaattttatacccagataaactaatcttccaggattttattcagaaaacagcaaagtaaatgctatataaaaatgaagacaatttaatcaaaatagatatattgttttgataatttttcaaataatactcttttttttgaggtggagtctcactctgtcacctgggctggagtgcagtggcatgatcttggctcactgcaacctctgcctcctgggtgcaagcgattctcctgccttagcctcccaagtagctgggattacaggtgcccaccaccatgaccagctaattttgtatttttagtagagatggggtttcaccatgttggccaggctggtcttgaactcctgacctcaagttatctgcccaacttggtttcccaaggtgctgggattacaggcataagccaccacacccggccaagaacactcttttaaaaaaaaaaaaaaagaaagaaacctatggcaaaactgctgatttgagactcttttttttttaaacaaacatttccagctgttgaaaacctatctttatagtagtcaagagaatgcagaggataatattttatgtgtaaatgtattccagggtttttcttctgactttgttttttttcagacaatcttgtatcatcttttacacaagaaccctgaggagactttctctagcgatgttgtttatttttgtagatgctactgtgttttaattaatattgagatatagattttgtatcaaaagaagcaagtggatttacctttgtcctagctgattgtagcatgtatggtgatacggtttggctccctgtccccacccaaatctcatctcaaattgtaatctccacatgtcaagggagggacctggtgggaggtgattggatcatgggggcaatttccgccatgctgttctcatgatagtgagtgagttctcacaagatctgatggttttataaggggctcttcctcctttactctctcttttctctcctgctggcatgtgaggaagttccttgcttccccttcaccttccatcacgattgtaatcctgaggcctctccagccatgtgtaactctgagtcaattaaacctctttcctttataaactacccagtattgggtatttatttatcacagtgtgaaaatggactgatacatatggctagaggggaatcacatagagcccttgcagaatcccctgtatcagcctcactgtttttctgttcatagttcatgttctgttcacttgttcagaggattttgatcaagagtaggaattgttcttgcaactgaagctttgttttgtcagttattacattctttcttattttgagggttatagcttatggaagggtattttttagtttctaattgaatgtgtgtttaattagaaactggtgcaacacatattgctctgggaaaaaaagttttggttcacgtgtttccatcaaaaattttataattgggttattgatcttcatttcaagatgtggatgattcagattctggacatgttgaatgctggaataacgagctcccagggacccctcttagaccagtctctcttctggttggtgctggtgctccatctctgcccgtcctaccacctggggaatctcaggggcccagatgctgcaggacttccgctccccctccttgtgtttagctcatcagaatggagatttcacagccttcttctctgggaatctccccacctctgactggcaaggccctcccaggtgcagcagttttgactttgggccttccctggccctactaacatctgaaacttactctccccagcagaaaactcgatccttttttgaaatggggggaggcagggatgagatggggaggtgaaggggttgccagggctgaatggtgagtggacctgatggagagggagaaggattggagagagaataaaacaactgccttttgtctgaaataagtctcccctcaatggaaatagcagctcctgggagcttaggaatggcccagtgtgcaggagtgctgaaaacacgcagagaacacacagcagaatgctcggagccacatttcaatgaagtttacagttttgaagtgcagtttaacaggttctgtgacatcttatgatatattatgatatattctaaggataaatgaggccttaaaaaccgagagagaccacatgaggaggaacagtgagctgcatagtgtgaaatcctacagaggggagagaaaaaaatgaaggagaaaagaagccatggaatggctttgtttttaatgaaaggggaattcccaagaacatctcaaaacgtaagatgtcaggttggaaagggagttgaatctacttcaaaatagatgatgggtaagaggtttctttttcaattcttgaaaactttgcaactccatggcagatcttgtcctcgtaggatttaaatgcgctgaaatttccatcctgaactctgccattttctttgctttagctgcctcacctccctatctccacgtgagaagttcagctgcgttcaaagccccgttggtgtccgaattgctgcaatccccaggttgccctctttctccagggacggggttggctctccagtaaatacctgctcatcccaccacatcttagaaaaacagctgtgatttgtaggtctatagggagaattgggcactcacagtttcccacaggaagcagttaaagattacagaagtagaccatttgtgttgctatgacaatggcctctctttttgcagacagggacagaggttttagaacctggtaccaacgtcttgggcatacagtgtttggtgttcttaccttattctaaatatattcggatacgttgtaggtttacattttttttttaatgttagtgccccctttagctcatagttgattcaaggtcccagtttatcaaacttttgtataaaatgagcaatgtgcaagccatttcctggtaacagccatggtggcatttaagacaccctatgggagctctgtgcaggcccagggagcaggagtgagccgggtggagccacagctggaaggcaccagggacttggggctgcatctgtgacaagcccccttcctctttggagaactgagcaaacttcacattgcaagtattccctttccgtgacacctctctactcaaataaatggatagtatttcatagaagcactgagtaactgaatgaatgactctcaactgacatatttgggaagattggactggctggcattatctccctccaaaaatagaagggggctcacagtgtttttatagtgacaggcatcactgggggttttctattttgtggacacattcactgacctacacccagcagccgatctaatgtccatgcagggaaggtgctcagcatggtagggggagaagggaagggagagatgctgcctcccagggctctcaggatcagggagcgtgccccttcctgggggcaggcatcccaggcctttgctctgcaggttcctctgtggtttcagagaccccacagggtgtggtgagggttgcggtgaggccactgactcgcgtcctgaggcttagtcatcctcagccgctggccctgttaggctatggcctgctttggggctgtcctttctcgcccctcccttgtctagggaaacacctgtttgtggtggtgaggcgagaagcttcccacacagcatgagaacagctcttctaggatgcacatgaaccctggcattgtcttaaagactgtgttcgtgtcatagcagaatgccccaaacggggtggcttaaatgacagaaatgttttctgttaccattctggaaggtggaatctgagctggaggtgttggcagggccatgatccccctgaaagcttgggaaggatctgtcctgggcccctctccagcatctggtggttccgtggctcggacagcctctctcccatgtccccacagagttctccctgtgtgtgtctgtctcctcccatggcactctccctgttgtgtgtctgtggacaaattcctttttttatatgggcactagtcatactggatcaggggcccaccctatgcagtatgaccgcatcttaacgagttacatctgcaacaactgtgtctccaaataaggtcaccttctgagataccggaggttaggataacaaaataaggattcagggggcacaggttcaagccataacaaagatcaaactactctcgtgtagaaaatcttgcaattaaatgtcataggttgcattattgtgcaagccccccaccatgttactttctgtcttcagactaactaacagtgctaccctctcagtctctgtgtaatgaggaagtctgaatgtctgaaggaatagatgagtgaatggatggatggataggtgatgggcgaatggatggatgggtggatggtagatgaatggatgggtggatggatggatggatggatggatgggtgggtagatggatggatagatggatggatggatgggtgatgggtggatgattggatgtatggatggatgatagatggatgagtgaatggatggatgggtaaatggatggatgaatgaatagatggatggatggatgggtaatgggtggatggatggatggatggatgatggatggatgagtgaatggatggatgggtgaatggatggatggaaagatggaatgatcgatttatggatggatggatgggtggatggatggatggatgggtgatggatggatggatggatggatgggtagatggatagatggatgatggatggaggaatgaatggatggatgggtgatggatggatggatatgtagatggatagatggatggaggaatgaatcgatggatgggtgaatggatggatgaatgaatagatggatggatggatggatggatgaatggatgggtgatgggtgggtggatggatggatagatggatggatgatggatggatggatgagtgaatggatgaatgggtgaatggatgaatggatggatggatcactggatggattgattgatggatggatggatggatggatggagatggatggatggttggatggatagatgagtgggtctatgaaagagcagaggaagtcctcgcaagtgttcctgctacagaggtgcatgtgtgcatcctgctgttcttggagccctagtagggcttgtgaaggagaaggaaacagatgcttctactcacctctgtgtgccagtgccctaccaggcacctcagtgtttgctttcattctcactctaaaggctaggactggtcatagcatcctcctttcactttcttcaaaacaactagctattgatcacctgctgaccaacaagtgctgaccaccaggaggggagagtgagaagactcttaagtaaggaaggtaggccaggcttagcctttcacaagtgggacaactgaggcacaggtgatcagagcagcatctccagctcccaccctgagtccggccttactccatcactccaggctatttccctgggtatcctggagaccacctgattcaaaaggagactttgccaccaaacagtatcctcccagaacctccgttgcttcatctgcagagtgaacccccgaatgggatatggtggacttgaagtgtctctcctcctttttcaaccatgggggccctgaagtatggcgggatcttcagtcccagctgagagcagctcctccatgctgtttataaacagggccttccctgactgctaggggctagctcaggtccaggttttcctatctgaatggtgtttgaagtttaaatcggtccacaagaaaattaacaaagcaaatggagattgtctagaatataatacccttgtttttaaagtttcactgcttttatacatattatatctgaatcagtgcaaacatatcaagacaaattagttcagtgatgttgtacacagaagagagatttcatgaaagtaagaaaatgatcttacatgtgggccgggagtggtggctcacgcctgtaatcccagcacttgggaggccgaggcggacaaatcacttgaggtcaggcattcgagaccagcctggccaacatggtaaaaccccatctctagtaaaaattcaaaaatcagccaggcgtggtggcacatgcctgtaatcccagctacttgggaggctgagacaggagaatggcttgaacccaggaggcgaagttgcagtgagccaagatcgcaccactgctctccagtctgaaataaagaaaagaaaattttcttacatgtgtatgggtcgagaatggcatggctggcctcggctgcccatctccttttagaaaaacattcattgaaatggatgaatgcgattttctcagctttagttttctgatcggtagaaaaggggtaacgatacctacttcattgggatcattgtgggattagatgcaattatgtaactgaaggcagttggcacagacaggcactggataagcacctagtcaacctaccctcccttccccttcttttgtgtaaatcctcacgcccccttctctcttcagcttctcctgtccctatcacagaataccacatttagagctgtcagtgaacaggcatgtgtctgaaagtcaggatttcctatttgagataaaagtctgcagtttccacaagttaatacagcaaacagaccaagcatcttttttttcttgcttggtggactcaggtaaaattgagctgctaagtacccaggatttatggaatttgttgctaatattaaagagatttacatgtccgttatactcctgtaggtttaatctgatcactacaaaatgcttagaatacgttgctatttcaaggacaacttgattatttgggtgaaagctggatctttgtatgtagacactctagattttggatgctaatctacttcattggttctttgcagttccttcagccgcccctgagaacgtgtcagccgaggctgtcagctcgacccagattttactgacatggacatccgtgccggaacaggaccagaatgggctcatactgggctacaaggtgtgtgatcacaggatgacctccctttgcttaaagagtgggctggggaaatgggagcatgtgctattcccccaaagcaacgagcttcctcttctcctacagatctgcagcgtcagccagtttgtgatttttattaagatattcagttgtcttatctaagcctcattgcagcctgggaattaggcatcagtataactatgacacaaatgccaaaacagggcaccagaagaaaagcacagccggagtggaactgacctccgggcctgcgcctgactctgccctcgctggcctcagtgccgcgggccagttactgaagccctgtgcttgtgtctccccgcttgtaaaacgggaataacgatggtagctttgtcccagggttggtgtgagaattcagggggtcttttacacagcacgccttgctcatgtgaagggctgggtgaggtggatcgctgtgtgcatgtttctatgtgtgtcatcacggtcctagcaatggcatccgctggcagggttgaatctgtcccagcttctctggggagccatttctgggttccatcttccatgcatccaccccacccctttaaaacccccttctgttcctcgttccatcactcggggcgacaggctctgtctccccatctgctccttggctcagcaatgccaagcatcagaatgagctgtttcggacccggccagcgaggccacgcttgtctcagtgctgctccctgggttttgagcgtgcctcctccacctttccgtacttcacatccctattctttgttttccccgcctgctctcccatgtcttctcccttccccgggtgttctaagtgcgccctgctggctctgtgacacatggcagtcccgttgaggggattcagtgaccaaaacttcacaccacattcctggggccccgagaaacgcgcttgctgtgctattttcaaacacctccctgctgatgctatcctttatggccttccaggtccccgatctcagggagcagttcagagaaggtgggcattgagtgaggtcttagcaggaggccctggagcagagcagcttggggtggggtgccctggaggagagcatagaggagagcagcttggggtggggtcccctggaggagagcagcttggggttgggtgccctggaatagagcagcttggggtggggtgccctggaatagagcagcttggggtggggtgccctggaatagagcagcttggggtagggtgccctggaatagagcagcttggggtggggtcccctggaggagagcagcttagggttgggtgccctggaggagagcaccttggggtagggtgccctggaatagagcagcttggagtggggtcccctggaatagagcagcttggggtggggtgccctggaggagagcagcttggggtggggtcccctggaggagagcagcttggggtggggtcccctggaggagagcagcttggggtggggtcccctggaggagagcagcttggggtggggtgccctggaggagagcacagaggacagcagcttggggtgggatcccctggactagagcagcttggggtggagtcccctggaatagagcagcttggggtggggtgccctggaagagagcagcttggggtggggtcccctggaggagagcagcttagggttgggtgccctggaggagagcaccttggggtagggtgccctggaatagagcagctcggggtggggtcccctggaatagagcagcttggggtggggtgccctggaggagagcaacttggggttgggtgccctggaatagagcagctcggggtggggtcccctggaatagagcagcttggggtggggtgccctggaggacagcagcttggggttgggtgccctggaatagagcagcttggggtggggtgccctggaggacagcagcttggggtggggtacctacagcatgcacagctgcagatggcccaaggaggccagagctcccggtctgtgtgaggacagcaggtcttctggggcaggaaaccagcttccatggctggaaaacccagggggctgctggctcctgtggcaggaagcagagtgttgtctgtgttcataatcgagtctttgttttagtggctgtggttggcatggctgcagttgggccctcagatcttgcagattatgaccaggcagcaggctcgccaagccgtgggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 354 - DNA, 139316 bp, Homo sapiens
tgggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatggtaggtccagggttcgcgccttcgggagccttgctgcctcccaggttggcctttccaatgcaaacaatttggattgttgtcgcttttaacttaattttcaaaccactttcttttgcagttgagggaaacaaaacaaaattgtttttcagtcactgagcacttatatggccaatttcagcctggagtggatttttacagcctaattatgaacctgtactgagtttccctcataactctgccgtgggcagtgctggggagaggcagcagaggctggggcggggccgagctgtggatgtcagctgtggacgctcctcttggcaggggctccacacacttcgtgtagtgcccccttatctggcaacacatcccaggaccccagggaatgcctgaaactgcagataaaaggagactactatagtttaaaaaatccacagtggacctcatgccttacttccctcggtactgccccgtctcactgtttgcattgtgggaggtaattagaggttatagaaagccccgtgctggatggcccagggtccccagctccctgagtttctggacctgaatcacaaggacgccttgccagctttgttttcatggaactctaaatcatcggtaaatatgttttcccactctgcagatgtcaaacacataaaggttagcgcctttacattttcattattaaacagactgtaatgaatacatcagggagagaaatgcggatctctcccgccacaacacccaccctggggatcggagtggctgaagaagtgaaacacctgtaggttttcttaagcatctttgctgagtaactaaatgagcccgaaagtcctcttaactgctgagtggaaagcactctctccacgttgctgagagagtgccacccctgatcctcgcctcgcctcacggagagacgggaaccctgcagaaggctttgtccatccttccctgacacaaggtctcaggctagagggagatccaggagggaatgggaatgtgggtgttgtttccttgcaaaactatctcctgctccagtgtattccaggtttcccagatgaaagtaaaaatgggcctattagaaactgtgtgtaacagcaggcccactgcaactgttccctcctgaagcaggcgctggtgagtcctggaatgccgctgcttcctctcccacagcgctcctgtagacatgccttcctcctctgctttccagcataatccccataaacagcctgggagagggctcaggggagcaacgctgcttaagtctgaagtcagcgtttgcgtatctgtgacttagtcctagttgggagcctgtggcctcctacagacatttatttcaccccaaaataggcgtcataacacacattcagaatttaaaatactgttcccagcttcatagccagggacagacgtcagcggcccagaacgacgaacatacatccttttattttgatattgattgtttcatgcccattgcctcttacctgggaatcggtcagttattaattccaacaagaagctctcatactggccacacacttacttgcctgttcgtttaagtaaatgtattttatgagggccacaaccctattattcagcagttccaccacacctagctgctttttcagttattggtgccccgaaccacacacaagaattattatatgcatttgtgcacaccaactcttaattatctaggatgatgcaggagagaggtggcatgcctacgagagaaatgattgaggatacacatgttatttcatcagaaattgtaacctccgttagagttgggaggaacttcaggccgcctcatctaccacctgctttgcagatgtcaaacccagtaagggaatccgagctcagatgagggaaatccttcctctcaacctgatgtttgctctcagagtcatttagtgactggtctacttgtgtcctggtaggctggttacactcacactattcctggcatagttcgtgaaccctgcttttgagtcttggaaagcagacgggcagggtttaaagggaagtgtttgctcaagatccttagggagccacactaccagtgacattccaaaagtcatcagtccaaaactttagggggttctaaacccacgacagtgtagcctgtggtagttactgcagccagctgaccctcggaatcctgtgtaacctgtcacgcacccaaggaacactgtcttgagatctgaatccctgtggtttttcccttcagccccaggcccaccagtgaggctcgtgttccccgaagtgagactcacctccgtgcggatagtgtggcaacctccggaggagcccaacggcatcatcctgggtaagggagcggcggtggccgggcgtggtggctcaggcctgtcatcccagcaccttgggagaccgaggcaggtggtttgcttgagcccaggagttcaagaccagcctgggcaacattgtgagaccccatctctccaaagaaaaaattcagactattagccgggcatgatggcatgcacctgttggtcccagctacttgggaggctaaggtgggaggatcgcttgagcccaggaggttgaggctgcagtgagccaagattgcatcactgcactccagcctgagagagagtgcaagaccctatccccaaaataagaaaaaaaaaggagtgatggtatttaaaaggagagaaataacaatcaagttgatgtcttccgtgtttgttagatgtttatgaggttaaacaaaaggctgtctccagcagcctagcatttcctgaaccgagatgatcatgggcctcttgactgttttctgagctacgtactaaaggtttttcttatggaatgaaattcacatttttttaacgtggaatttcttccattcgtttgcggctcatggcgataccgtttgtaaccgaccttcccttcctctctgaaatatcaggctatgttgatgtgtgtttgagaaacaacaggctagtttttcagagaagatgcagacctagccttggttcccatgttcctggaaacatctttctgctgcagcacttgcacccaatccttgtaagaagccgctgagatgaagcgcatgccctgggtcccggggaacgcgtttacttctgacttttcagcattacagccagcataccaactctggtaacacagatgaaaagcctgaatttttccgttccccaaagcaacaaattctattttaaaacatcccagttccttgactcattcaccctttcacagagacaaagtaaggactttccctgtgcaggtgtcgtatgtacagtggggggtgaggaatgaatgaggtgtgcctgtcctcaagttgcccacagtcccgtaagggagacacatgttgagagtacagtgagataagccatctgaaagaggtttcattcagtgcctcacacacagctccttctgggtggggtctctgtgggtggaagtctccttttgagagggatctggagataggtggcttctaaagccttggaagaagggaagggggctgtccactcagccaagaccgaatgctttcagcctttgggagcactgacagctccaaggctggggatggaggctgggccgggtcttgagctactgtgagctccctgctgtgtcctggagaatgtggccctgagacctggacgttttaaactggcctgttagaggcaagtgcagcagccacagaacattgccccagccccaggttagctctcgggatattgccataccagacaccccgattcggctagcctgtgttctaggtgatttacggtaaagttataaacccagacttacaaacaggtggtaaaattcaccacttttgcctgcatttgatcttaggattctaagacttggtttgaagaaagagtttcacatcactaaaaaaaagtttggaggcctgtgttgaacggcagcaggaattcatccaaggtctttgagtgggaaagctgcgcaatcagatttgccttgtaggtaatcactccggcagcctgagaagggtggacggaaagtcagatatttattgagcccttgcttccctgagagggggcctggagcttcctaagtcttctgcacaaggaggctgtgacctattttcgctttgcctctttctttatgtgatttctggagttgctagacagaagtgtttggctttgagtacggcatttctcaatcaggtgacctttggaattgcgggttcctgctactaaaatctcagttgagcagccaccttggaggtgagcatttcagggcctggcccggcggagagggagctatgagccacatctggtgcctgcgcagtgagcccagtcttggggtaggaaatggtctgcccagcagacagctgtggcgaggagatttgcaggagccccacccaggcaggccctaacctcagcacagcacccaggcatcagccttttctggaacaagcagggctaatatctgattacccgggagctgtccccagcatgctgtgaaacaagaaacattgacagagtcacaggagtccacaacaacagtgttccccgtgaagaagcaggctcgccccagccccacctccaccctggcagggcccctggctcccactgccggcctcggtagaccctcccggcaagtcctcactctatggtcacctccgtccactcactgtcagcttaccgggctgccaaggatcagttctggagtgcggaggcgtgggagcggtgcaggagcaaagcatgtgcttcatctgtgcttctctcttgccacagacggacgcgtgctcagattccagtactgtgactttgacccagggcgtccttgcacacgtggggaggctctggcctcagccggctctaggccccgccctctgcctgacacccacttcagggcatctgccctttctgaggactcacgccgatgtcctctgtagccccgggtcctcactgccccgctccctgcacgtgtctacctggtgaggcttctcctcagcacgcccgccggagtgaggcccgctgtccactgagcccatcagctggttttatcatctgtcgtttactttccagactgtctctgacatttctttttccgatgacaagagcactataaaatgataattgaggccacaatgaaatcccatttcacattcgccagatttggcaccataagtagctgtgataatgccaagtttacatgaggatctggagaaacaagacccctacacccttgccaggagcgggagtttgtgcgtccactttggggagtgctcaccaggaaaggtgagcgcattcacactgcaccccagacgctctgcacttccaggccttcgccctagagaaattcttgcctgtgtgcacaaggagaaacgtacaaggatgttcattacagattcactgaaatagcaagaaagaaagcagctgtcgtctgcacaagtcagatggcacgaaccttggggctgcctgcttttcctttcccctgtgttttcaacactgcatcacggacaagtaggccggcagcctgggtaacgttttggactcagatctcagcctatgcttattagctgagtgaatttatgcgtgtttcttagcattcccatgcctcagtttccccatccctcaaaggggaagcacattcgtgcctccctcactggttagagttgcacttagaacagtgcctgccacatagtgagtgctgagtaaacgttagcttccgtatcagatcgaatatttcatcgtttccctggcaccagaggaggctggaggctccctggacttgagagctcctcctagaccattgggggctcagcctggtcctagtattcccgttgcatgcagcagtggtgtgctgccttgatttgtcctccataactctggttgctgaagcagaggcttcttgccgacaagagaaagaaaacttagaaggctgcttgggttacagagtgttcctaaagtgcgtcgggaggtatggatcttgatttgtggtcactgaaagccactgaagcccaagtgaggagaaggataatcacttaaatactttgagccctccaaccgtgctgaacgctgctgaatcacacagcaccgtgtctacctgcgaggcagacaacgtcactgccgagcctcctctgtcatgcagcattggcttgtaattgtaatgcatgttgtccgggtaacctgtcacccatgggtcattacagccggcacaccacacggcggaggctgcaggaagacaggaagacaattcctgcaaattcagatgggtgttcacaggggagaaagcaaaacatcttttcgtctgactcactttacatccagagaccttgaatcaatgttcccactctggcagcttggccttctgagtacataaacacctctgccgcccgagcttttgtaatctatatcaaaacatgttcttgcatttccaaaagagattaacagcgtgaaccacagcaggcacctagaggagaaaacacttgcttatttgcgtaaatattttactgtggagtgcttttagcatttagaacttttctttggggggatggggttggaaccccctgagtacagacgtccctccctcacccaccagctgacaccacatggccttgactggtattacgctaacgtgatgatgcgtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaactctcagacaatgccttttgtttcccagggaagtgcacaatttattaaaggtttgcaactagctgggcacggtggcacacacctgtaatcccagctactcagggggctgaggcatgagaatggcttgaacccgggaggcggaggttgcagtgagccaagatcgtgccactgcactccagcctgggtgacagagcgagactctatctcaaaggctttgcagccacctaaaacgtccggatagaagtctccaaattgctctgtgtatagctgtgcggcgtcagtcttcaggctgacctggagctgagatgcctacaaggcttccagtatccagcctcagctccttagtgccaccttcttgtgtctcgagcagtggacggttctggaacttgtctcaggcccgtggcgcagtccctttctggattctgattgtctaaatgtgcagtgccacctccgtcttccaggtgtattcagaaacccactcaggcctctcacttgatgtttttaatcttccatttggatcaatgtgtctcgtacttggccttgctccttttaatgctcatattatcataattcacccatacccttaaaaacagggctcctcgtaagccgcattttactgctgctattgattcggcctgttcattcctccctcgcacacgccgccgtcttctggccttgcgtcgctgaagtgcagcgcactgatgtttctgatctcgctgtaaccgtaattacataactagccttttccacagaaacgctcttatctctgaacaccatctatcattattctctaaaaatgcaaggactgctactcagctgctcctttgtgccatttatgtacagaaaaaaagctgtcttctattgtccatcgagtctaggactttttaaacgtgtcaaggtgagctataggcattcatctttatgttcagcagaccgtggtgtggcgaccagctgatattatctttattttagggcaaataataggaaggtacaaatagaacacacaggccaaggagttttcttccagtgcctagggaaccagatcagagagagaagaagaacccagatttctgcaattagcagggatgccgtcgtgctttgcaatctgcatacattgtctcactggggctttgccaggcctgcatcctaaaggtcaggggaggggagggcgaccccactgcaaactccccccttcctacttgggtccagcggcactgccacgcagtgcactattaaacagtcattaaaattcatgcttctaaagggaaaacatgcttttgttatgttgtgcagaaatcgcagaatgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctcaaaaaaaaaaaagagagagaaagaaagaagaaggaaggagggaaggaaaagaaaagaaaagaaaattgatgactaaaaaaagtcccaagacagctacagttatctctgagtggcagcatggtcctcctgcagaccagcataccatcaccccagcttccaggccatcacctgggactctgcccaggggctttctgtggctgccggagcctgctaggttttgaggactgggccatacattcaaggggtgcccccaacagcccttagccaaccgctgagaggcagtgggcgcacactgcagctccccccgtgtcatgtgttggggacgaggctaacaggttctccaccggcccccacagtgggaggagcccagccccacggcccctgccttgatgcacacacgttcatcagcttcttctccgtgtcacttctctacccaccccccatttcctggagtgacctcccaaatcgccacttgcactccagtcctggcctcaaggtctgttcgtggggcacccaccctagggccaaaggtgatttcatgggtttttttttcctgctttttttgggtggcttttatacaaaagaagcatctatctatctgtatgtataaacaactatatatgtgtgtatatatgtacgtgtgtgtgtatatgtgtgtgtgtatatgtgtgtgtgtgtatgtatatatgtgtgtgtatatgtgtgtgtatatgtatatatgtgtgtgtatatgtgtgtgtatatatgtgtgtgtgtatatgtatatatgtgtgtgtatgtgtgtgtgtatatatgtgtgtgtatatgtatatatgtgtgtatatgtgtgtgtgtatgtgtgtgtatatgtatatatgtgtgtgtatatgtgtgtgtgtatatgtatatatgtgtgtgtatatgtgtgtgtgtatatgtgtgtgtgtatatgtgtgtgtgtgtatgtgtgtgtgtgtatgtgtgtgtgtgtgtatgtgtgtgtgtgtgtatgtgtgtgtgtgtgtgtgtgtataatcttgaaaagctgaagccccaggagcgctatgggactgaggggctgagagctttagcaccgcatcagagggcctcgccctgcgctgtctgggctgtcttggagctgggtggagccctcgggactcaggcagggagagtccatcgatgggaacgatctggtaatggggcagggccccaggcctccctgaacaacaagaccccactgttctcccatgagcctattcattgtgcacctctgggccagctctgcaaacggtgattcctgccaggcccacactctggaagtgtgacctccagagtgccttgtccccctgtcaccacctccctgggagcacacaggttcccttcctcgtgctctggctgctgcagacagtggcgctgctcctgcaggccttctctgccgccccgctccaccccagcctgcacctcacaggctgctcgtccccctctcagatcagtggctttgcctctggcccccgctgcatagcgctctccctgggcccacctcagctgacctctttcctgatgttactccccaaggctcttcccgaggactctctttctttggcactttctggaacaattcagcctccccagatgggagccctcacatgctggaggcgtggctctggagctgggcccaagtgggacccccggccccacgatgaggggctgtttcttgatgttttgcagtttcccccactctgtgtcggtcaccttcagaatgtcctgctgagtgactttctctgaattgttttctgtttttttctcccttttctttaatcatcagaatcccatcatactgcagcaggggggagctgaggccaacagcagggtatcctgggaagagctggggctcgatgccgagggaccccagccctgccctgtttactgtgtgctcgtgggcacccagcccctccttgcctgcaaatgtgaaatggaaacaggaatatctgcctggggaatgtcatgaagtcttaatatggtagctatgaagtgcctggaatatagaggcccctaataagctgtgtctccattttaaaaaatgattaatagaggccagacacagtggctcatacctgcaatcccagcactttgagaggctgaggcagaaggatcgcttgagccgaggagttcaagaccagcctgtgcaacatagtgagaccccatctctattttaaatttttaaaaaaatgattaataccaagagatgagaactgagagtcaggcagagattagaatttgcctgagggctgggtcaggagccaggtctcccggctccctgctgtctagtcaggagcttctgagagagaggcaaggaccacacacgaaaaacaatccacaaacccgaggcagtgtatcctccaaggcaagtgaggtgaggcccacgtggggcagtgaaggggcaagtgcataaccacatgatggaagcctgtgtagtctgcggcatggccaaaggcagggctcaccttggaggacagaagagtcaggtggggccattgatagaaaggagggtctgtaagcaaacctcagacagcttggcaagaagaaaccagttcccacataatccccaaatcctgtgatccacaaggagtgcctttgaacaacatcttcatttcatctcaggattattacctctagcaatggaataatctgggcagagataaaacatggtgaaacagtaaagattaaacaataatgaaaacacgtctgtaaccatgccctgctcctgaaagtaaataatacctcattaattcagacatagtcactgaaaggcaatttggattttgagcgagaagtcttaatcacacacaactctccaacatattaagtaatgaatcaagggaactcaggtaggctggtgggatccataggaaaggcatgttcctggccatcggggatgctggggaaggccctcgttagtcgtctgtcggggccaggcctccaagcatcttccacacagggctttctctttctcttttagggataggcatgtttttgttgttgtttttgagacagagtctcgctcagtcgcccaggctggagtgcagtggcgtgatcttggctcactgcaacctccgcctcccgggttcaagtgattctcctgcctcagcctcccgagcagttggcattacaggcacctgccaccatgcctggctaatttttgtatttttagtagaggcggggtttcaccatcttggccagggtggtcttgaactcctgaccttttgatccacctgcctcggcctcccaaagtgctgggatcataggtgtgagccactgcgccctgccgggataggcatgttttttcacacggtgaagaagaaatctttttagccacttgtgcaaaatcagtgagatgatcccacctcgacagtgtggagggagcaggctgaaccctacgcatacatacatgagtctgtttttaatgcaaacttgatttttgctgccttagcgaaagattcgtatctcttcatctctaggaacgatattcagatgcctgaacttaacactgggttacacatcattcttggtggttttggttttgcgtttttgttttttgttttgttttctgtttttgctggagacagagtcttgctctgtcacccaggctggagtgcagtgacgtgatctcggctcaccgcagcctccgcctcccgggttcaagcgattctcctgcctcagcctcctgagtagctgggattacaagcgcccgccatcacgcccggctaatttttgtatttttagtagagacagggtttcaccattttggtcaggctggcctcgaactcctgaccttgtgatccgcccacctcggcctcccaaagtgctgagattacagccatgagccactgtgccctgctaaagttttgtatttttagcagagacagggtttcaccatgttggccaggctggtctcaaagtcttgacctcaagtgatccaccctccttggcctcccaaaatgctgggattacaggcgtgagccactgtgcctggctgctttgcactctttacctggcacatttgcatgatttttgagccatgtgaatgttacacagctcaagaaatcataacaatattgaatgtctttagacaaaaggcagcttaagcctagaaggtctccaagatgaacatcgattatgtggccagagatgctttttccaggcagaacacagccgcccagagacctcagaattagggtcattctcccagccccgaggaagcaggacattgttggggaatttacattttaagggggaactccgacccagggagtcctgttctgaggcacacgctgtaggtagttaactcaatcaggcattgcaaagttgggggtgtcactcctcagggctgggctaggggcttggccatgtctgttctgggcccctgtgctgcttccggtgggcattcagcaccctgtcctggagctgcaggggcctaaggcaccacgcccatatcagtgcctgtggacaggtccggggaataaggttccatggaggctgtgaggaatgataactctgtggtcataccggccaccacagggtgaggaactgctagggaaggggtcttgccagctggaggagggaggagaagtcgtgactgcaattgttttataataatattaaagccaggagcaaccaggcatggctgtgccagccaggtcattaccaccgtgagcccccagagccctcctggcaccccgtgaggtgtcctgccatatccttgcaccatgtagtccagcaaactgaggctgggagaggctgcatggctcatccacggtcacacagtgaatgattggcagagcgggattccagcccagaggtgcacccccaaaggtgtgtccttcctttgaagggcccgctagcttctattggagaggatgcttctgcgcagtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatcttggagcttcacagcctcgtcctcatccttgtcttgtatgcttcctgacaggcctgcggcgagggtctggcatgggaagcgttgcagggatgcagcagggtccctggatgtgcctagcagtgtagccgctgtggtcacgctctcctcaccgtcagagtgcggggcggccaggagccccgaagcctcagactgagcttccattgtgtgtgcacggctgactccctactctcactgtgcaagggtcggggaaacgggaggcctgtgggaagagctggccctctccctactctcactacacaggggtgtgggggaaggggaggcgtgggggaaggggaggccgggggaaagagctggccgccgtctctaggctgccctcggtcagtcagtgactgggaaggaacaggagtctagcagggacacccttgccagagacctgaggccagcagggccacatccaggaagtctcagaactcccggtccccattgtggggaagacagcccgtccactggaggcagggcagcggctgcgacagccactctgggggcctaagttcagggtcctgcagacacctgcgcctagaggtggctgcgtcatggacagggcagggcgtgtgtccctgtctgtgtggcggtgatgacggtgctgatggtgagcggtgatgcctggggcctgatgtgaggatgcccttgaggtctgatctccgtgtaattgtcctcccacctcccagatggcgggctggggaggggtttgttaaatgcgtggatgagtgacaaggcgcaggagctgggaggatgcctgtgagctcggtcgttcatgaaccagagacctgagagcaggaagagctgagagagggaggggttcacccggaacagaggctgagggcagggggcaagcagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctctggggagcagggagggactgggtccctgtggcatgctcgcctcgtgcccgcatcctaaggaaagatgaacccgtgttcacaccttgttctggtgaaggatggagcaggaaacaagcttcacagggaaatccacgtggggccccaccattcatcacagccatgagaccaccctttcagtgcacaggcagtgacctccagagacggggaagagacagatggccttccaggggtcagcacagggtgtgggcacagggcttccctgtgccgtgggtgactggctcagcagctgtctcccatgtcacctgcctgcagggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagaggtaagaccttgggggacccgggggtactgcagatgttgtgggcacagcttcctcaatcaggccctctggggtctgcggggtacctgggaggcttcggccttcccttcggagaaagagaagggatgtgagcatttacaaagcacccattgcacctgacatggagctggacacactatcaaacagcattgcattcacaccttcagcctcacacctgctctctcagacacgtgagcactgcgttcacaccttcagcctcacacctgctctctccgacacgtgagcattgcattcacaccttctgcctcacacctgctctctcagacatgtgagcatttcgtgacacactttcagcctcacacctgctctctcagacatgtgagcattgcatgacacactttcagcctcacagctgctctctcagacatgtgagcattgcattcacaccttctgcctcacacctgctctctcagacatgtgagcatttcgtgacacactttcagcctcacacctgctctcagacatgtgagcattgcataacacactttcagcctcacacctgctctctcagacacctgagcattgcattcacaccttcagcctcacacctgctctcttagatatgtgagacggtctcaggtttaaggaaagcaacattgctcgcagaggctgagtacctggggcaaggctgcagagtcaccacatttgaggttgagctccccgaaagcagcccccagtctctgatgttaaacccacgtcctccgtagagcaggtgctcagtaagtaagttttccaaataactgccttcccaatgagaactgccgggcgagcagggctctgctccacgcacggagacaggtgctccatgcactgcacttggcctatccttcctgcagcccacggagcagcatggcattagctctgatttttaccaaagatgagacagaggaaactgagagagttttattaatttgcccagacacacaactgcagagctgagatttggactcccctctgacaccacgaggccgactcttcccatgaaagtctatagtgggcgcccttctcagtgggctccgcgcatgtcctcgggccttgcagcgtccagggttggtgccacaggaccctcacctcagcagccccagctcccactccaggtcctgatgtcatggccagacccagggaccctgtgggaatgaggacgggagggagcttgcaggcaccactgcagggatacttggagcacacagttctggccacgctcctatttttgtttttttatttttgaaacaagtcttgctctgttgcccaggctggagtgcagttatgtgatcataggtcaccgcagcctggaatgcctgggctcaagcaatgctcccacctcagcctccccagtagcggggactacaggcacacaccacccagctaattatgttctgaagagacagagtcttgctatgatacccatcttggccgcccaaagtgctggggttacaggcatgagccactgtgcccagctaatattttaatttttgtagagatgggggtcttactacgttgcccaggctggtctccagctcctgggctcaagcgatcctcctgcctcagcctcccaaagctctgggattgcaggtgtgagcccctgcctttggtcctcccatagcattcagtgaaagcacatcccctctgtgaccattaccactatcattattattgttattagctggagggacggaagccctcagtcgccacagacacccgaggtgcttctgcaatgtaaagcacatggaagggatgccctgtgaaaggagcgcccctatccccctgctgccaccctgggtatcagcactcagggctgtcggcttctcaggaagatggtaatggctcccaagcaaacgttttgacttctttctctaatgtatttgtgtggttttatggttcatttatcttaaacattgactgtgcccctcccgcgagccaggcacgtgtgcaggtgcatcacagacacggtctcacagcaggtcctcttatttccccgtgtcctgccccacagccccgccccacagtcccgccccacactatgccacctgattatccggaccagagatttcggagattttccattggggcccccatcctccatcctcgtggctcagggagagggaatccaagagacttgctagttaccactaagtccaagagagcctttgaaacgggatacgctgggccacctcccctccggagaccaggtgaaatcacaagggccagaacgtgtgcttacggaggcaagtgctgatgaagtgagacgggagccctcctcccacacccgccactgggggccgacaatcaattgcagctttacacacgccacgcattctaatcagaatcaataatcttcatgataaacaattaaacaattattccttccgccgcggaacttctctgctgaaatcgatggggtgcagaggcacagcggcggcagatgatgggcactccaggccgggcctggccccaggcaccccgcgtcccgcatccaagctactgcacacaccagaggcagtgacagcccagaggtgccctcacctacagcagcactgagtagatgccgtagatgctttaggccctgggtgactgcaagaaggaggaaattcagcgttaaaggtggactgagcacaacatcagaaaaagagagaccaaagggaccacagggcttggaacagcccccaagaccctgcgaccccagctgtcatcacagacacagtgcctggtggtctggcagcccagggactcctgtgtggctttgttcctgtctgttggtctctatgagtagtgcatccgaagtcagccttaagatagctgctcagctgggtgtagtggctcacgcctgtaatcccagctctttgggaggccgaggcaggcggatcacgaggtcaagagatcaagaccatcctggccaacatggtgaaaccctgtctctactaaaaatacaaaaattagctgggcgtggtggtgcacacctgtagtcccagctactcaggaagctgaggcaggagaatcccttgaacccaggagacagaggttgtagtgagctgagatcacgccactgcactccaacctggtgacagagtgagactctgtctcaaaaacaaaacaaaacaaaacaaaacaaaaaaacagagcctctcatctccctgacccaaggaagggactggcttcagactgtccaaggcatgcaggcagctctcatgggcaagcagtcagccctgtacagcagcgtagcctcctggggatgttccttgggaagggcagcctctcacatgtccctggtctgtcctcatttggttgcagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacaggtactgagagagcaggagcacctccccggggaacggggccctggccgcctccagccagctcctgtccagatagtggggaggctgtgtgggccaagcaggtgcacccctgagagcacaggccccctttctttttgacactccccatgctgggaatcccagaactcctgggtcctggagctacttccaagggcccacccccagccgcttcccggagtctgctcttccaggtgtgcagggctggtttggtcaccccaggacccagggattggcgaggcaggggtgatggggggcaggctggacatgtgggctggagtcctagcccctcccaaggctggcaatggggaggggaccatgtggaggagggctgggctggcctcgggtgtccagggctggagggacgttgcgtccccttgcgttctcgaaagcagcagggagatggatggcaccacgagtactgtgcttccttagtgatggctggggaagatgggagggcatgcctaggacacgactagaatccgtccactcactcagttgtttactggacctctgggctcagcatgggagagggttgcattgacaatagcagcggcgttctgtgggtcccccagggtcctcacaactgcggtttacagacccacccactctttacagacaaggaaactgccacagtcacacagatgggcatcccagggcttagaagccaccccaggagtccacaccctcaccacatgccctgaccaggccctcctggggcctgtctggttcgcaggccctgcctgggcagggccacccgggacacccgccttgtgcttctcattggcccagagtttggtcacttgttactgagctcacactccaggctgtggagcgggggtcttggagtgagtccctccatgtcgcagggctctggagcctgcaccaatgactaagagggtagaggggccaagacggttgtctccaggctggccgagcttcctctgtctctcagatggtcacataggtcagctctgcgtccctgcagtcacccagtaaggggagaccatgatcccactctacagaggaaggccaaggtcagaaaagtcggtcatttgctcatatcccccacccagcctccgtggcgcccagccatcctcgtcttcgaggctgcccgtctcagcccttcctgactgaacctgaatgtagggagggaggcaggtcccaggtgaagcccctggcagctcctcagaacaccaccctggccccactctgccctgggggcaaagttcaggctttggagtgagggctgattggagtgtgggtgtaactggtcctagatgtgacaacagggggtttcaaagagaagagaaacctccaaaacccccatccctggcttgaggaccaggcccatgacagaggcgaagcacttgcccagggaggggtggccgaccgggcgtctcagtacagagctgtgaagctggaactgtgcaggctcagcctggcttctgccacttgccgttgagtgatctggggcaagtgacgggctctcaggtgtctccagctccctggcctttgagttgcgaggcttggaggtgataaggccctttggacggtcatggccatggatgccagtatcgcctttgccaccccacacagtgtccccaggaggcacagctgggtgtcaaatgcaaatcctgaccagagtccctgagcagtccaaggagggtcacacggaccatcgggaacccatgctgcggctcccaggcccccattggagaccacagaccagcaaggaagccagcgccccagtgcacagctccagctctctgtggccccagaggacccaccctggcacagtcaccctctgcagtctcatggtccaagcagccctctgctcttctgaaaatcgaggtggaatggtccctgcgcacggggcttgtttccagcaaggccagagccattgcctggcttcccctcttacagggcacaacatctggtgaggtccgtatgctggcgggttggaatttagaaaagctgttccgtccccacaactgtggttatgcccctcatgttaggaaaacgaggctgcagcagctccggcttgatgtcccctctgaggtgttttccctggtgatctagtcactcagcttccagacagttaaagctctgacaggacttcaccaccaccaccgccatcctcgtcgccatcattatttccggaatcccctcatcctgtctagcacctgtcattttcaacaccacttccatgtgtcatttcatacgatctttgtaacaaccatgtggacatgcagcccagacttctcactattcccagtttacacacgcagacattgaggcagagatatcttaagtaacgcatatgcaggtgccttgacgtctctaaatggaagggatatttcctgaggtttttgtagttgtcacattccgtgagccagaggtcaaggctccatagacacagtccacgtcctacagttaatttacaagggtctgcgacgtatgaaaacccagtgtgtgtgcatctgaacaccaaactttccacagtcagtctccccttagtagctgcgtggccttggaaaagtccaacccttggctgcctgctaggactctgtcctctcatctgtgaaaggcagggctggagcggggatcctgctgttccctccagctctgtgagtccaaggtttgcctcattgctgaccgccacggaactggcagccaagaaataaggcaatcggaagagtcagactgtccgccaggttcctgccagcatctcacttgccctttgagctacagcaacagaactcgaggggcacagctctctcccctccagaggaaggcactcctagtggcagataccatcctcccagagccctggaattctcctggcacagccccgagggtcaggggagtatggccaggtgcgcccagcctgacttaataaagtacacaggatgcttagcttaattggcagtgtgctcacatatataaataacctcaccctttgtgtaaccatctaaaagaaggaaaaaaaatatccagccactattcctgaaggcttctgaagccaaacagactaatcgtgtgtccgggacttcatgctggcaaggagaggtccatgtttcaggacagacagtttaatttggtataggagagaccaatgtcaatttcctaatgggccagaactaggacaaatgcttcctctgcctatcaatagagaacatgtcacaggagaatcccaggaaagtgatattttgtacactgccacagtataatctcccttcctgtttaataatcctgacagctacattttactttcaccagttgtgtgacatctgtgagtatccagaaaacattaagagtttaaatgtctcaatttggtgactgtgactacgtccagggaatatgggtcgagacccccagggagaggggttgggtctgagacgtgttcaggtgttgccagtgtctggttggtggttgaagttgtgagacggggtagccacccacagaaatgcagtagagaggaagaagagaagggctctgagcccagtgtgacttggaggttctggatgtcactttaggacagagcagtggctgtgcgggctcagggggtggctgtgcatctggctgtgatgggctcagctcctcctctgagctctgtcgtgggataggtgcgggggttccaaacagaagacagaaaggcgcagagggaatgagcatggaaaacagcagggattcaacgaatgtcagcaccacggccctagctccttttgactgatttcttttttttttttttctttttccgtataatgtaattttttaaaaatatcattatttaaggatcagatgggctgggcatggtggctcatgcctgtaatcccagcactttgggaggccgaggcgggtggatcacctgaggtcaggagatcgagcccatcctggccgatatggtgaaaccctgtctctactaaaaatacaaaaattagccaggcatggtggcatgtgcctgtaatcccagctactcaggaggttgaggcaggagaattgcttgaacctgagcggcggagattgcagtgagctgagatcataccactgaactccagcctgggcaacagagtgagactccatctcagaagaaaaaaagaatcagatgaacttggccaaggatatgatacatgagcttgatattctttgtgatacaatagtgaggtctaagtgtttgtgtttgtttggttggttgttttatttgtttttgtctgtcacctgggctggagtgcagtagctccgtcatcgttcactgcagcctccaactcctgggctcaagataccatcctgtctcagcctcccgggtagctaagactacaggcatatgctatcgtgcctggctaatgtttaatttttttttttttagaaatggggtctcactatgttgcccaagctggtctcaaactcctggcctcaagtgatcctctcacctcagcctcccacagtactgggattacaggcatgagctaacatgcccggccaatagtgaattcttaagaaacatttttagtgccttccagataagtaaataaagacagcagtgaatcgctttaaaaagatgctcagcactcatccattttataatagaaccaaaatgaaggaatggagctcctcctatttaaaagactctgcatttagctctgaggcaggaacgtggaacttaagctatgtccttccccgacgcccattccagaacactttggctgtggaggtcaagtttgtgtatgtgattagccgtccgaggcagtacgagtacaaactggctttctaaatatatcggttattgatttggggtaagcaagagttctgatagcaagttcagagagtgagggtcctgtattacccaaattatttatttcctgagtttgggatgattagaagaaagagattagatggcagatgttatctcaaaaatatccctaaatctatccagcttctgagtttgtatgtggagatttgggaggtgaggcatggggaatgagcaaaggcccggggagtcaccaggcagcatcagtggcttcctggggacaagtgagggctccggggtgggggagccagagaaagctttcgggaagacaagaaagagcacatcacatttattcattgcctgctgtgtgccacgatccacccgactccatgaggatgcgtgatgggatgtcattttcacgacagccctggaagccccggtgctgctatctccatgtccatagccgaatacagcaaggctctgagacactgacttgctccagtgagtagtggcagagccagcattggaattctgcttagcccactccaaagcagaggtttgggctggcttggaagtgtgaacagagtgcagaattgggaggagttagaagggttacaggagggtgttcttgcatcctgtgtgcatttgtccctttatcatggagtcaccaaaatccatgctctgccacaggagggagcatggcaggagcaacgggggtggggggcttgaggatcaaacatttggtctaggaggtagaccagtcatccacaggagcagcgctgcagggaggtgaggcaggttggggtgagtgcacagaggatgctaccgtctctagtactgcagagccaggagaggggttgatagcactgccctctgcctgcctcatttgggcagtggggctgctgctcccatcggctgcctgctggagctgctttctgcctggttttgggggcactggcgtggcttccaccgagagggttaactcccccagatccgcattttgtgttccctgcagctcacagagacacttaatcaatccttgttgaatgaagtgagtccggcaaaacacaggcctcacgctaagaaccctgctctctgtcctcctttgcacccaaacccatttgtctgggagccaggctgatttgtccagccacctgacacgcacttatggcacaccacgtgtgcccggctcagtgccagacccaggcaggacagtggagaaagaggggtttcaaggagcttgcagtgtggctccaaacccccaaatcatagcaaagtgtgaagtactaaacagtggagtgctgagtataattacagttcaatgccagaggccagtgagaaaacaaatacatcaataagtaagcataatcgcaaataaataaataagtaaacaaatcatttctgcaacacctactgtgtgccagatacaacactggtatttacgtgtcctcataggcaaccccccaccccagcctgagaaacttcgcagatggggaatagcatccttattcaatccttccacccatagatctgagcacctcctgggtgttcttggctcttgggatacagcaggaaaggaggccgactcggtccctgtccttgtggatgttgagtcttgtaaagacagatagtcgtcaaggaaatgtcacccatcatgatgcagaagatgaagggaaggaacagggcacgggggacagcaggcagggccatctgagcagatacttgcagatccataggaacagctgatccttagtgagcttgccccacaccacacacctgactctgctgagtgtctcacctgagtttaagcctcacctcagtttcacgatgcctgtgctattagcccaggtaaggaaactgaggcaaagtatgctgtccaaggttaactgggaggtagaagccaggcagtttgactttggggtccacattcctgatgcccactctgctgcctcctggtacaggagccagtggggctatggtgggtggcgcagggggaggaggcagggaggtcgtgggagaagacacatggttatcacccagatgaggcaaagtaactcctaggatgccaggaacagaggggaaattgtttgttttaacttagcaaaggctgtctaccagaactctggagcaaaggtcatttttatggtcggacttcagaagcatctccattaaagctgggaccaaggccagctgtctcctgtggctgtttttccagttgtggacgctgagtgcagagggtctgagatgtgcctgcggtcagggactgggaagtaccaagaccagaccaggttctggagggctgcagtggaaaagcaggccttgaggtgtgagctggtagagaaacagtgtcacctggtcttaagcaggacggggacctgaaagcaggaatagaatctaatcatggtttccaaaaatggttatcagttttctaaaaagcagaatccttcctttaaaccaagtatgacccaggccgaatgcataaacctgatgggcatggagctcttgttggctgatgggggctgtgtgggcctctggacttcagagacttcagagtcctgggggtccacagggctccatttgaaagccactggtttacagattccattgggagtgaggacagaagactggttttcaggtgatgagggcttcggtttagagtgatagttgagacttttagacatgggtaacagaggttaagagtcctgaggcaccccgagttttctggtctggaaactgaggaggatggagccctcatctatgaagagccgctgcccgccagggaggagaacagagcagtttcctcacttgctcattcggaagtcgaatgaagggtatctgagaggaaccagccagtgactgggttgcagggcgggtccctgaccggctggggcttcaccaagatcccagcattgtctgcacggaagagtttggctgaagtcttagtctcaggcatggcatggggcttggcacaggagacccattgcatgtggagtagctggacggacggacggaaggaaggaaggaagaatgaaggaggggaaggaagaaagggaagggaaaaggaaggagggacgggaggtggaagggagagaagggaagaaggaaggaaagtgggaagggaggaagaagggagagaaggaatgaggggagggagggaggaatgaagaaaaggagggaaggaaggcaagagaaaaggagggaagggaggtggaagggagagaaggaaggagggaaggaagggaggaagaggggagagaaggcagcaaggagcggggagggagggaggaaggaaggtgggtgggcagatggaagcgggcccgaagtgctaacagcagaaggcacctcaggaaaacatgagtcccgttaaaatctccgtcgacgggctgggggtatttttcacttggatgcttgacagggatgtggtcttttgtaaagtgacatgtgaatattgccatttactagtcttgtagcagtgggcctcagttttatcatccttgaaatgggaataatgatgcctcctctcccagagctcgtgtgagttcaaaggggttgcacttgccaagcgcctggcaccgtgtcagccccagtgaatggtaggggtgcggggctggcgggtctctgcctgcagccggccaggaagtggaccttagagaatgctgcaaggctgggtctggcccagtaaagagctccaggaggacggagcgtgagaatcaggcaggaactcattttatacttcggatcagcacaagggcccggggaattagctcttcctgaggacttctctggatcccttggagagcagtgatgtgccgactagagtgcaggggtggctccagtgaggggttggcactgcctccccgaggagccctgagcagaatcttccccctggccaggacgccctgcactccctgccctctgtgcagctcctttctccctgaggatttcaaccgtccaggtgttcaaaggcttctcccaggacaggtccagggtctccttcaagcccctgctcattgcacctaggaagtgattgggtccgacccaagaacagcctccttgctaagctgtctcgggcccacacaggagcccagagctctcagggcaggggagggatttgcccctcttcccagggcttcaccaggaatgcctgagggcaggacagggtggcagggccccggcagtcacggtctcttccacattgcagactgaggcccttcacctcctacaagctgcgcctgaaagccaccaacgacattggggacagtgacttcagttcagagacagaggcggtgaccacgctgcaggatggtgagcaacccggggcccagaccgcgttcctggccgctgcccctggagcccgagatacttaggccacactttcgtcttgagccagaaaggggccaccagggagtggtggaaagcagtagaattccattagtgacagacagctcggagggtttccgcacagcctgtggtcataaatcaaggtttcaagggcttccaaatggaatggaagtttctttgattggcttctaaagcccctactatccattagcatcccagaaattgaataattgatagggtcattaaaaataaatgtcagcgggtagctgggttttaagagattttccccatttttctcattcacgagccactctttgacaacagcgcaggtaagtgatgggaagcgaggtctcctcagagctccaggtggcgttttcagccgctccgtcctacctcggcggcgtcaggcctgaagatggattgttattctgtgtggcccaggcctgtggcgagcccaggaggcagctctatcagccgcgtccagcggtgatcacaggacgggtgggatggaaaagagtggatggtgggtaatagctcagctcccaggctggaaacccagtacttagttcacccagcagcgtttcatcatcattcccgcaacctatccccaaagcactgtcttttccatttaacgctccagtggaagaattttccaataaaccaatttccagctggctcaccctgtgacctcacatctccacttctgctctctcgatgacctggaagtgtggtttctcccacataggcctcccttggcctcagggaccagcagagggtttgagcaaaccattcccggcttctcagcaactcacagaggctgttttgctgcaaaccctgcactcccagcagagcagaacctgcaagagcctccaacaggccccagctgtgctcccaggaaaagcacacttgcccctggaaaagcactggctggcttctgtggctcctgcctctcatccagctcttttctgagcacaaatcctgggagtttattggagctttggggaaagccagtgagaaagagaggagccgtcccgggtatatggggtggtccagggccctagtgagccctgctgggccctgaggagccgggctgagccccaggagctcactgtccaagggtcccacatcgttagattcaaccaactgtggattgaaatgttcagaaaaaaagttaaaaatacaaattaaagatatacagtgtaacaactgtgtatttgtttggagagtgttatgaccttgtacaatttctagattactcatgagagctcctacaattataacattgtaacattgttatgtaacagtattacaaattataacgttgtaggaggactgatgagtaacctagaaatgatttaaagtatgcgggaggatgtgtgcaggttacacctagaaatgatttaaagtattcaggaggatgtgtgcaggttacatgcaaatactgcaccactttattgttagcaaacctggaggcaaaagctacttgtaactggaaaagcctttccggttaatctacttaaagtggggaccaatttcacactaaaccacaagggaaaggctttgcaggaactaaattacaaaacaaaaactatataaatgcattcattttaacgttacctttaacacagttgaggtaatgtttgcaactaagcactaaatcttagaataaagaacaaaaccccacacaagctgatgtcattgtcgtaatctctctgacagattgtgtgaaagcaaagtgcaacagcctcctttgacctccagggcagcatccaaaaggaccatttttgaaaaaaatattgaagggcctcttcagactccagaggcctttcttaccctttgatattcagattgggctttgatgcacctatcttgtcatcgccttccctgggatgtgcagtttctctttgcaatggagttgcattgtatttgtgttgtattgtcttacactatctagagattgacaggcacagactctctccaggggttggggaaccctcggcaagatagggagagtcctctgagtatgtggacggtttactgatgaacagtttctttttatagtgatttctatttccctgcacaacctcacaactcaaggacattgagaactccctgtaatggcaccgctgtatcaccagggctgtcaggaagctggctagagggcccaccattaagctggaaccacaggaggttaagggggttggagggagacccatccctaaaacagaacggggaaggtggaggtgtgactgatgcaggcactgccagggctgaggagggggtgtctggcaggtccagaggaaaatcacagagccggtgaccccgggacccaatcttgggttctaagtggagaggcatctgctagatgcacaagtgtgcctgtgggaagaacatcgtcattccgttcagtgaatatggactggatacagaatgcgtgtcacacttctgctgggcccccgggatcttacagctgggaggcataagagttcagctcaatatgccaagacaggaccacacagatttggagggagcagaggaggcagggaagaggggcacagaagacctcttggatgtggcagatgacaagaagtttagtttggctagagtgcagggcatggccataggcagaggtcaaaccagccttgtccctccagagagcagagcagaaccatggcagactccccttcacttcaccctgctgtcccagccagctgcaacctcaccagaaatcaatctcctttcctgacagccttttagtgtttcaaaccaagtgacctggcatgatcatgtgtcctattcaggaaaagtagctctcacctaggtatcttaaaaaaaagagaaaaagataagttcccctgctctcccagaagacctgagccctgcagggagggtctcgagccagagagctccaggacagcctcactggaggggtggctctcggaatgtccaccacagggagagcccagtctgggtctgtttctcggggccattgttaaggttggctccctcctatcccgaggacaggctttgaaggagaagctctgggaagccccgaggaagggcaggagaaggggacccctggagaaggaaggaggcagggctcaccagcctccccatactcactgagggtggccctgggaagggcggcagaacataacaaccaccctgacccccgctttcctctcctgtgtgtttcagttccaggagagcccccgggatctgtctcagcgacgccacacaccacgtcctctgtcctgatacagtggcaggtaagagcgcggggaatcacgcgcgttttgtcaaatgtgttctcatttccctgcgcattcagccacaacggctgacatggactgcaagctgagccctgagctaagcgtttgagagtagaaccaaggagacacaccctcagactcaaaaacgcgagggggaaatggtgtcaattatcatctcggtgtaatttccaaaacattagaagcaggactgtgatgcacgtagagaatgaacttgactccccttattcaggagggaccggcaggatggggaggccagtctgagagcgttggaggaactgggtatgtcttggcatttcaccgaggacgttggagcaaggcttctgtgtatacacaaattggttatcgccctacaaggcagtaaaactgcaaccgctggagttagcttttctagagaagtcatctgcaaccagacaaaatatctaccggattgtacatattttcccaaagtctgggggtgggtggtggtggtggtggtggttgttgttgttgttattattattattattattattattattattattattattattattttgggacagagtctcactctgtcaccaggctggagtgcagtggcacaatctaggctccctgcaacctctgcctcccgtgttcaagcgattctcctgcctcagcctcccaagtagctgggattacaggcgcatgcccctacacccaactaacttttgtatttttagtagagatggggtttcaccatgttgaccaggctgatcttgaactcctgacctcaggtgatccacccacctcagcctcccaaagtgctgggattacagacatgagccactgtgcccagccaagtctaggcctttaatctccaatgtgcagtgagttaaatgaaggcatattcttccagataatcacacactccttgttgggcctgctcagcaatgctccagtaaggcattgaaggacacgctgccgtctctttcccttagtttcaattttgggcaatgcttactgacaagtacattgatgacaaatataacagagggacaaaactgcccaaggaagggctgcaggccccagggagatcccagctgaagagtggggcggggagctgtgcggaggactcagcccagggcctgtgtagcccggatccggggcagacagatgttgagtttccccagggctagagcttggcctggcagcagacacaacagatggacaggcagggggccaagcacgagggcagagtcaaagtttctggcccacagggaggttcctgaggccagaatgggggctgctgtgccagggagctgggaacatagtgggatggggccagcatggggtgggtacggcatgaggacaggtcagcctgggagtgcctgctgggagctggggtcaggagggcagtctggtgggcacgagattcttccttggggctgaagctgtcctcaaggacaatggcagggtgcccgatgcagcaggtgggaatgatggttcgggaagtcaggagaaaatcaagaggggaacagtggtctagacatggccttggagggcgaggggatgtcccggccacatgccctccgccggtgcaggggaggcaggaaggggtcctgtggaaagtgggggctgcgggaaatggaagggatgctgggaaacacagccaaggccaccagtaggtgtcccagacagagcatctcccagggccctgcagaagggccactccaagggacagtggcttcactttgcagcacggaggatgaggtccaggaccaggctaggacaggaggtgccagagatgcctgctgggccgggagagagacgtgctgagtgagcagcgccagccgcagccttcctgggcatggtcttgaggtgcgtagtgctagagatgccagagaggaacccggtgagcagagccaggctgggctgtgggtggggccagccagggggagcttgggaggggctccgctttcaccctcttgctgtatgatcctatgaaatatgaccatgtttgaggtatgaaagtggcaatttatgtgattcaacctgatatcacttgctactgccacttatctgagggatggagagtaggcgtttaacaagctgggttctgtgaagagtgtgtcatctccttcaagtgtccatggaggtgtgcggggctgcgtctcggctgcctttctcttgctaagggatccagcttctctgggtaggataggaacctttccaggcaatgaaagaatgtcccagtgtctcctggtggaactggaagagcacttctgtggcactcagccctactgagtttaccagagcataggggggccagagtgggaaccacgaaaacagcctgggccccacctctgcccctgggaagccacagcccctgatctgtctgggagccactggaaaagtgacgaaggacccacccgcaacttgccatcgggtgactgtggccctgagaggcccctctgactccaggttcctcctttgtaagaacagaaggtcacaaaggtgagctcaggtctcacacaacatctccagtctttgggggccgctagacccccagacccgagcttcagccctgactcccgtgagggtctccggtgggaggttagagacattcaaaatggaaatgcaaagtcccaagtgctcgtttcccagcctgcaccaacacagtcaatcacaagaacattggcactttgtaccatgctgaatcctaccagaaaattcacattttctttgtagacgtggcggcagcctgccaataccttacctaggtaagctcctttcctataaaggcagtgagcatcagggctgggatgcgtcacctcctccaaacaatggttgtgaaggcatcacttgctgtcagccccagtggacggtgcagggctcgagctccccttggtgctgctggacagctcagggacgtgcctagtgccacctggaggagctgggctggtgtgtgcatcagccgtccccctccagagcccaacagaacaaactaattgcaagaagaccagagcaggaggtggtcaatacaacgtcctgtagaaataaatgcttgtcaactgccaggcaattgaagtataattaaaattatgagtaatttactgcattagaacaaacagaacaaagaaaaagaaactaggtttaaatatagatttgcattccaaataaaatgtttcacctgtaaaccttttgtgttttttgttttgttttgttttgtttttttagtaattactttaaaaatgcaaacacagggccagcactttgggaggctgaggcgggtggatcacctgaggtcaggagttcaagaccagcctggccaacatggtgaaattctgtctctactaaaaatacaaaaattagccgggcgtggtgatgggcgcctgtaatcccagctactcgggaggctcaggcaggagaactgcttaaacccgggaggtggaggttgcagtgagccaagatggcaccattgcactccagcctgggcaacaacagcaaaaccttgtctcaaaacaaacaaacaaacaaacacgggctgtaatttcaaggcttatagacccatttaaatgcctcccttagtagactgtcaggcttgattattcttagtaggacagtcaatccttgcctttcatgggatccagttctgtttgaaagctaaggagtagaactccttctgtcttccagggtggagtgcagtggtacgatctcggctcactgcaacctctgcctcccgagttcaggtgattcttctgcctcagccttctaagtagctgggattacaggcctgcaccaccatacctggctaatttttgtattttcagtagagacaggatttcatcatgttggccaggctggtctcaaacccctgacctcaggtgatccacccaccttggtctcccaaagtgctgggattacaggaatgagccaccatgcccagccttgtgttttcttttaaagacagggtctttccctgtcacccaggttggagtgcagtggcgcaatcatagctcattgtagcctccaactcctgggctcaagcaatcctcccacctcagcctccccagtgtctaggactacaggtgtgcaccacgatgcttggctacttcttcaaaaaatttcatagagatggagtctcactgtatttcccaggctggtcttaaactcctggactcaagcgatcctccttccttgacctcccaaagtgctgggattacaggtatgagccactgcccagcctgtaagtgggttttgagactgttttctagcaaagaaaaaaatcccaagcaattgatcacaccatacgggaggctctcagtgtaaaaggcaccttcccagaggagggttacatctgcctgggcaaaggcagggaggcatcccgccgcttcagaacacatcttggggctgtttctttttctcttcacttgtgccacccacagaggaccaacacctgcatggagtgctgagttccagaggggactgaggcaggccacagaatgtgaagagctttcattaagcgcagtgggctctttaaggcattgataggaagacagcagaaggaacgaaactaactctggccagaggggcacctgaatgcacttggcaggactgccaggcccctgcagtgaaaggctggagaagcgcgtggcccccggcacagcctgaggaaaggctcacgggtgacgtcactggtgtttgatgttgtgtctcacgggtattgcgtgttgagcctcctgtgctctcagaaccatcaggaccaaactccggagagaatccctgttctactctccacaaagcagaaggcacaggatggaaagtgaaagctcagatggtttcactgagcttccggcccgggggaccacggtggccggatcagatttggatttgggcacctgctctgcctgaactcgcaggagacagtggcacgtggttgagcctccctcagcccagctccctgtctctagaactaggagagttaggccctgccctgctgctcccctacctcagcagagagagctgggtgggaggttccacagaggccagcaacggcagagggtccgaggtcaccgttcaggcagctggaaggagagaggctttccctgcaggtcctgcctcctcctacccccaggccttccctccactcaactctgtggctccaaggtgcccaccctcctgggtcttccccagaccattgacttcttcctgcctcccctacctggtgataaaacccaggcacactcctaccaggtcatttgcatttaaacaggctcttttgctgtggcacgcctgtaatcccagcactttggtaggctgaggcgggcagatcacgaggtcgagattgagaccatcgtggccaacatggtgaaaccccgtctctaccaaaaatacaaaaattagccgggcgtggtggcgggcacctatagtcccagctactcaggctgaggtaggagaattgcttgaacccgagaggctacagtgagcaacccaggaggttgcagtgagccaagatcacaccactgcactccagcctggcgacagagcaagactccgtcttgaaaaaaacaaaaacaacaacagcaacaaaaaaacgggcttttgaaaaatgaagaacctccaggaggctgctggcgaatttctgaggcgtggcaggcacagggaaggtgttttgaggcaggactcccagttcccttcaagcttctctccacacagatggccaagccagggtgcagtgacacacagatgaggtcatgttgaactccggcaagtcccactccaccccagggctctgactgagcatccgccatggctgaggcctggcccaggtgctctgggcatttaaacatgaacaagacccgaacatggcctgcccctgggcatatgcagagtcagagacatgcgaagggctggggacacgggtctgtggtgcaaagcgaaccttttgtttccagtcatataatactctggaggccatctggccagacttctgcctgtcttgggcacagggttgagcctgggagtttgagcagtcagcccaagcttgtactgcaaggtggctgcaaggccacgacccaaatctagagcctgaccttgacctcatgggttccatggagccgccctgctgatgcctccgagcacctccggagttggagagcctctttcacagattacagacaggttaatcccaaagtccaggaatggaaaatatggttgaacccagttcagaaccctgtgcaggcaggcccgggcatctctgtgaagccaccggaccctttgtaagtgacgctcccactgggaagatgacacctgctagcagagtggcctctgccagctgctgccttcaaggaagccaccctctgggggcacggccgcctggaccccctccccaggcctggaagactcctgccaggagcggatgcattttgactcttcagtgatttctggtgcaaacagcatcagttagcctgttggccaaatgtggccccagcccggtggctgacggacactgtgtctgttgggcaaggcggattggccatttcttatagctctaaatcatctcattcgcctaggctagaaatatctgtgagtccaggatcagtaatcttcggccccttcccctccatcttccagccccagaggctgggaaaccacacttgggcccagggagaacatttttattttcccaacctcctaacttcctgcttagttgatagttttggtgaattgaatccagccttcgtcacgccacctgagcttccctcctcccccagaagtaaattgcactctctgtaatcctgtcttgtctgtgcatctgcagagctggctgaaggcctctgcagtcttccttctgaggtaccagttcctcgagctgctgcaggtctattctggggcgagagggaggctttgaaggtgacctcagggcgaggttgcttggctggtacttacagagcccctgctgtaagcttttgatctgtctgctcgcctcttcgtcatgctgatagtcagtccagagcccagaaatggaagctgaggtctctcatcttcactgcccagactccagccactcccaccccaccaccagtgtgaacagcaaggacaggactcccagcaggaccgcctgggaccatctgggtggaccaggagccttgggcaaaacaatccggctctctgggtgcgcaggcatgtgctgggtgagagccattagcggggacctgttgctgtgtggttgtcaggggcccaggagaggaaagtcagaagcccccagggtcttggaagtcactgccatctctcattcagcaaagggctcctgtcagtgcatttttgcaagactggttgttaccgggagtagcagtaacccaggaatccaccaagcccatccatggctccggtggattggaggaagctccgttctggccagtctccttctggggagcccacccaagtggggaatgacccggcacttgggctagtcctggctcaggcactgggaactgtacctgtagcctggctgctgctcctagacccacccagacctgcccctgcccttcatgcccctcgctcccgtctagtggggctacaccaggcactgtgcccgccttgcagagggccagcccttctcccctcatcaaaagccgcctcctcctccaagggcagctcaaacgccattccctgcagttatcctccagttcttcctggcagtgagctcgccgtctctgaggcttcagagccgccttcctcactcagtctctggcacccggtgcactatagctcaggagatctcctagatgcaatgagacggcaaggctggaatatattccccaaggggcggagctcagtgtttgcgtgcattcctccagtaacatgccctgagctcttggtgagtcagtgtgaggagacaggtgcagcttttcaaggagccacagcaccaggccttcctggtggctctggcactgccctccctccctgcgggagggcccctgggcacagagctctcctgcctcccttagagccacctctttgcagtggcccgagtcacacaggacagatgcgctgtattctttagggtcagcagaatgaccatggaaagcaaacggccatggagaacacttccttggggctcagtacagaaaccactctgtctcctctttctgaaatccagatggcctgcggagaattgcctctcttcagtctcacataccgacttttccaacttttccatccattgtatttcttctaagaaggttaagtaaaccttctatttcattgtggctaacagttgtgtttgaagaaggatgccttacagaataagggttttaatttcagtctcagctgtggcccatgagataaccagggctagagtttgaaagagcagactgcaggatcacctaagcccagtagttcgagaccagcctgggcaacatggtgagacgtcatctctacagaaaatttaaaaattagcctggtgtggtggtgcaggtctgtagtcccagctactcgggaggctgaggcaggaggatcgcttgagcccaggaggtcgaggctgcagtgagctctgatcgcacccctgcactccagcctgggtgacagggtgagatcctgtctcaaaaaaaaagaacagaacagactacctggaacccccttgtgtggtgatgtgagtggatgtgcaagtgtgtgtgtgttatgcacacacaggatttccaccacgcccccacatctctggtggtgctttcatcacgacactgtcgggagccagattgcagttgcatataatactgaccggtgcccactcctagcacaagggactaatttttaaagactaagagtaaaacaactgaaaacctaaaagctgctctgaatgtgattctatagactccacagggaggaaaccgaacatgaaccccatcaacacccccagtttttaggagactgtctgacatgcccagccctaagggatggggtgcagagcaggactggcggcccggcatgggggagctggagaaagagcaaatgagcagcccaggacacctgtgagtgactgttgccggcgtcccaaacactgctttgtcgtcaaaatcatagaaaaggaaaagagcatttagtaaaatcagcaggcactgtagcctcccctacctgttcccctatccagcctcgactgtgcctgtaattctcactccttccttttctgccagctttcagcttcccaaactcatagctccctggtcaggtttggattttattgttttcctggcaagttgagtagtgctgggaactccttgagccggtgaaggggtgcctgctggagaaaggggtcagtggccacagggtgtggacggatggggtggccacgtgccccagggaccctgccgtgccttgctgatcgtctgccgccgcctcgggtacaccgcaccctggagagaccctcatctgtgctggctcactttctgctttgtttctctagctctattactggaggcgctttgaaaagcttttccatctgtagattgtcccgatggaaggcaagcagcgccggggagggagcgggtatccagagaaaacctgggatgcccagttacatctgaattccagaagaatcattttcagattctgatttagctgggtgtcttgtttttttatagctttaaaaaaagcaaaaaaatcaagagagcctcatttgacattgaagtcccgggctctggttcggcggttctggcctggtagctgagcatgctccagccccgtgaaggcggccagccagggccagagtagagaggctggagcagagccggcaccaaggtcccctcatccactggtggtggccagtgaagggtaaagagagaaaaggaaaagccagcagaaaaaaagtccctcccagataatagcccaactccaccgtccatttgagaatttggagctagatgccgggcagtgccatttccccatctctggtctgtggtgggcagcgggagtcctcggacctggggctgcaagcccgcaggatggatacgtgacccttgtaactttctgcaaaattgaagagggctgtggggcattgacaagcacaccgtggggggaacacaggggactcagacgcgcccccacccccagacgacagctctctcagcccctgggtttgctcactggggtccgacacccctgggccaggagcggagctgtgtccaggctggagtagtgtctaagggtgtgggtttgcagggcctctaagacacggatcgcaaagacccagcaaggccactcagttgttcccgttatgcttttccgcgtctgaggggggattatatcccgtcgtgctgttcctgaattgggagcatcacaggggtgtcagaaagtcctcagagagggacagctgctggcagccctgcatggcagtggcctgggggctgcttgagctaatgtggtagcaggcctcattttggaaaacctcctgagtctgccgggtacacacggtgcccctctggcatgtgcgtgtcgcatgctgcatgcgtgagtgttgaacgcgtgagtgttgttcctcgttgctaccacagtgcaagcccccctcactatccaagccattctgtcggagagcctggggagcaaagaacaccgcttcctccacgtttgggttttgcctcgtgagtagcaagagtccaaagaaaaagcgatttctctaaacatccaacccctcctggtgcctgggttcagatagtgaggaccagagagagtttggattgcaaggatgtgttatttaccgggggcagcaaaacaagttactacgcattaggtggttggaaagggcagagccttattctctcacagctctgggggccaaaagtccaaactcaaggtgtcggcagggtcctgctgcctctgagggctccagggaggatccttcctgcctcttccagcttccggtggccgatgacaactcttggcgtttttcacttatggacgcgttactccagtctctgtccctgtcttcatcgggtgttccccctgtgtgtcctgtgtccaaacttccctcttctcataatttccctccactcatcaaattaggaccctcccctaatccagtatgaccttgtcaaaaccaattgcacgtgcaaagaccctgtttccaaataaggtcaggttcacaggcaacagggcttagacttgagcgtgtcttttagggggacacagttcaacccacagcaaaggggctctcgtgcagcaaagctgtggctccgcccagggagcaggatggtgctgcggtgtgggtgcctcacagtgagcccgacaccggaagttctgtgcacatccgtcctctgacgaggcttcgtggcctcgtcttcagccatcttctggtcacagcttagaaggttcctgttccttatccctcatctgagtatcccaagaagagaccagatgctcggaggctcagcacccagatgagtgcagaagtcactgaggctttccagggcatccgcctggagtgggaggacccttctcagtctcagatttgtctcctgcgtggaaacatcctccccaaatgtacttataaacagaaaccgactgaaggaaaaggcaagccttgcgctgggtctcgagtggtgaacagccacatcctaaagtggacaggtcttgaggtctcataaccctgtgtttagattccagcaagacctgaaactccacttccttatctgcctgtgctccctattccatgggagtctaatgtgtgtctaatgagcgcctagccatggcttggtaagaactgcagggtgagagctggatggcaagggtgtattgtttgcctggggcagctgaagcagatcaccggaccgcaagatgataggccaggccagccatcatgcgaggggccatggggattccagcctgaggactgagtccggcacagtggggtggcctggcatggggaggcatcagtgaggggtacagtacggcagccacagcctggatggccaggggagtgagggagggtggggtcagctggtgggtgcttcagagcaggccgcctctcgaggttccaccctgctctgggctcaccacacagcacccagcctcctcgccgtctgtgtctgtccccagcctcctgccccagcctgggggctcatttgaggatttgagctggacaggggtcaaaatgctgatgtccccacacacatgcacatgaaaactgggattctgagagtatctccacagcttggtgctgtgccctgggagctgcctgggttcgtcttgatgaatctgacacctgtcgctggaacccacgactttcttctgtgcagctggctagttaaacaggggtggaggtgagccctgctgcaggccagctgggttgactcccatggtgtggctgagtcggtgtgatgtctttgcagcctccgagggacgaaagcctgaatggccttcttcagggatacaggatctactacagggagctggagtatgaagccgggtcaggcactgaggccaagacgctcaaaaaccctatagctttacatgctgagctcacaggtgagactgtcccctctgtcctggtacagggagggaggttcccaggggacccttggtatctgctcagtgcacatcatggtgggaaacgctgtggaagaggctgagagaagaggcagccctgccctcaggaacagggagcaggcgggtttacccaccaggggcacacagggtgcaggtgtgcggcaggtgggtgcagctgcggaggcagaggggccttgtctaccacagactgtgttaaggggagagcagttgccaggcctccagtgactgcactctaccggcgtcagtggggaagggctttgggacctgagatggaggcagggggccagtaggaacctgttgcaaaacccaagtccagggacaggccccgcctgtctgtaccagacagcctcagcgtggagcccatggtgctcacccccgggctgattttggctctgcctgcactgcgccatgatcgttgctctgacgagggcccagctgccttcaagacagcttctagaaccctggagagggacggctgccctgcccgttcccacccctcctctgttggatggaggttagagggggttcatttcctggcacccaccaaacggtgtcacaaaaatactctttgccccttgacatcctcgtgccggggacagagtgaagaagcagctccagaacacgccgtgtggacggtgccctcccgctttctgccatccctgtggcaccagggctgcctacctcacgcgccaatgccagccgcggggccttccacgcacccagtgcgcggacggcagcagctcctatgctcctatgctcacacagcttgaccccagtacagcgccaggcatgatgttgatgaatgttgaagacgggaaattgcagcactggtgtctgcactgttggcacaccccaaaggtggcccttgctgaccaccagacagttggcatctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggagaaaaggtgtcctgccactcagtgctaagttgtgccaaaaactagcatgtttcactgaatcagagtggtaagcacaccccgcctgtccgggactggggtgccttgttgtttacgaggaggtgcggcagcccccgcaactgggagctggtggaaagcttgggcggtagcggggtctttattgccccgggaggcgcagcgtgggaagtggctggcatcccagtaaggcacctgtctcccttgttcctgccgcacatcacctgcgatggccgtgtccctgcgtgctaaccacctttctgctttgcttaccccaatagcccaaagcagcttcaagacggtgaacagcagctccacatcgacgatgtgtgaactaacacgtaagtgcgctctcagcgggaggcccatgccgcgaggcgcacacactgtgcccagagccagctggtctctcagtgcaagggaaaaccagcctggattaatggctccagttctggaatcgcctctcaaacgctgcgtctccacataccaaaccaccagggagataggaaaagaagcttctagaaacagaggctggggaaatttactaatatctggtcttcaagtttgggacagagaggaaagccagatagaacaagatctctgatctctccaacttccttcttcctttttttttttttaaagaaacactcttttttcttttcttttctttacttttttttttttttagagacagagtctcactctgttgccgaggctggagtgcagtggcacgatcacagctcactgcagccttgaactcctggctcaagtgatccccctgcctcagccccccaagtagctgggactataggctcatgcaaccatgcctggctaattgtgttttgttgttgttttttaagagacgggttcttgctatgttgtacaggccggtcttgaatgcctggactcaaacgatcctcttgtctcagcctcccaagatgctagggctataggcgtgagccactgcacccagcctttctttttttattgtggtaaaatacatataacagaaaatggaccttcttaaccatttttaggtgtacagttcagtggcattaagcacattcacactgttatgcagccgtcaccatcattctccagaactttctcatcttcccaaactgaaactctgtccccattaaatactaattcgttatacccctccccaccagcatccacattcaactttctgtctcgacggatttgacgactctggggacctcatagaaggggaatcatgtagtatttgtctttttgtggctggcttgtttcatgagcttaacgtcttcaaggtccaagcacgtgagagcaggcatcagaatctgagtcaagactgaataatatcccatcgaatgaaagaccacgttttgtttctccactcagcctcccttcaccctttcaataaaccacgttgtttctcctttgattcccagctagggaggagtttcaaaatccaactcaagggctagacgtggagccataatgtgatcgacttcaacacacagaacttggctggtttgggaagtggaccaggcaggagggaggggctggccctccccgagcctatgttgtgttcaggcattctgtaggggtgggagtgatttgcagggcagcacagctccaacatgttgagatactgactccatagcatgggtggaccctgtaagcatctctttgaaggcagccgtccaaggacgggcgcctgagtcacggaagctttgctgggctggtagctggcaggaggcacaatttgcaggcccaagcacaccaccatccacaccagcacacaggtgccaggcacacacatgggacctcggaaaagccaagccacccacagagcagtgttaaccagtgggagaaccttccagaatgttttggcttaaaggtcaattattctcaccctgtcacttagtgcggagctggtgcttggccccctgccctaaggagttctctgtgtacagcagcccacgcccgttctttcccaggacacggccgctaaggtctcagaggcctttggttaccagcgtccttctacattctattttcaatgccacagtcttactctatctgttcataatttcaaggagagattctgaaccaaaaggcaggcccaggttatgttatgtattctaactcaggggtctccaaccactttgacaccaggggtgggttttgtgggagacaatttttccatagaccaggtggtaggggatggttttgggaggattcaagtgcatcccatttattgtgtactttatttccattattagtacatcataatatagaatagagtgaaataattctacaactcaccatcacgtagaatcagtgggagccctgagcttgttttcctgcaactagacggtcccatcttggggggaggggagacagcgacagatcatcaggcattagattctcataagagtgcaaaccctattgggaacagcacgtgcaagagagccaggttgtgcaaggcataaggagcacgcaacctagatccctcgcacgcgcagttcccaatagggtttgcacttctgtgagagtctaagctgatctgacaggaggcagaactcaggcagtaatgcgagggatggggagcaactgtcaataccagtgaagctttgctcactcacccgctactcacctcctgctttgcgacctggttcctaacaggctatggctagtggcccaggggttggggacccctgttctaaatcctttactttagaggagggagctccgtgctgcctcttacctgaacacaggataggatgggtacgtcttttgcttaatggtggtgggtgcttagttaataggagagaaggagggtgccccggtcacagtggatgcaggtatttcacagatttctaacaatcccgcctcctctccttggagggtgctccttgcttcattgtggttcatagggggaactttggagaaagagaaggtggtcctggtggaagctgatccatatttccttcaaccctgcagatttaaagaagtaccggcgctatgaagtaataatgaccgcctataacatcatcggcgagagcccagccagcgcgcccgtggaggtctttgtcggcgaggctggtaagctccgtgcacccccaaccccactgccagagagggccacagtggtggggacagccaggcacgctgcggccaagcccctcaggtgtccagcagcgttctttctccttgaacacattgctgtcggggctgaggtctccacgccactggcagggaaagatgggctcagctgagagctggaatttcctgacagcttcagtgaatggtcaagtcttgcttttgagacctaaagggtttgttcgatacctggggccatcatatttactgtggctttgctctacgaaagtggtattaagtcagtggtgatgtaggtgtgtgggaaatggaacctcgttatctggaggggcagatgtttgtatctgcatgggtccttcagtgggcttcggcagtggcctggtgacagcccattctctaggtctgggagagccatgtgggccattgtctccaccccttttagataagatgtgactgttgggtctgattcaagggaccttgccttctgtggggctcacagtgggaagcaacgtctatttttagatcagatcctgtccctatccctctccgggcccagcgtgccgcaggtaatgagagcaacgccattccttcggccaaggagaccacagaacctcaccctcctcgctggctggtgactttaaagagttccctgacttcacatagagcctgatgtttctgctcttttccgctggtgcagatttagaagggtgttgtttcaggcccggaataattagagtgtccctgaggacagaggctcggcctagcaggagctgctgcatagtggggagggtgagatgggggggcaggggcggctcggactgcgggggccagaggagggaaacacatcaggtgaccttttgcaattgggaagggttattgttatgaaccaatcaatagcaccaagggtcaagcccagcggattttttccggaatggtcaagcggtatttgcatacaaatgaggatgcgtggagagaggcatcaagagcatacggtatttctgcctctctttgcacgaaaatatgttcaaaggggtcactcagagccaccgaggtacggctcagctttccctcagggatggacctggctgtagaggagcccattgagggccatggtggggccaccaagggtgctgtcagagaggggtgccagggtgccgtcagtaaagggtgggtgccactgcggacggcggccatggcagattctgtgctctccagttgtattcgggtgactgggccccagttggcccccatggctgggggtgggtcagcctgtggcatcgggggagcacaggaaaggagggccgggaactacagtgtctgaactgcaagcagaaggtgtgggtgtcagagctctgcctgagggtctgcctgcgcctgggcataggacaccaggaaccagggggctcagggcacttgggcaggccctgagaccgaggcagacgtccagagaaaagagcttcagcaagcggtagggaagccaggggtggtgcgggaaactggggagtcgcgccagggccagccaagcggcaacaggactggatgcccagcaaacagctccagctctatgcccagcgcccagctccagctctatgcccagcgcccggctccagctctatgcccagcgcccagctccagctctatgcccagtgcccggctccagctctatgcccagtacccggctctagctctatgccctgtgcctggctccagctctatgcccagtgcccggctccagctctatgcccagcacccggctccagctctatgcccagcgcctggctccagctctatgcccagcgcctggctccagctctatgcccagcgcccagctccagctctatgcccagcacccggctccagctctatgccctgtgcctggctccagctctatgcccagtgcctggctccagctctatgtccagcacccggctccagctctatgcccagcgcccagctccagttctagggtctgcgctgttggtgtcttagttccttctcacactgctgtaaagggacggggtaatttataagaaaagacgtttacttggctcacaattctgcaggctgcgcaggaagcatggtggtctctgcttctggggcggcctcaggaagcttccaatcatggtggaaggcgaagggggagcaggcatcccacacggcacaaacaggagcaagagagcgcaagagggaggtgccacacatttaatgaccagatctcatgagaactaagccattcatgagaaacccacccccacatccccatcccctcccgccaggccccacctgcacgttggggattatagctcaacatgagacttgggcagggacacatccaggccatataagtctgtcatcgtggtaagatgcgtataacatggaaagcattctccgtgtgcagttcagcggcattcaggatggtgagcagccatcaccaacatccatcgctggagctgtctcttcttcccaaacagaaatcccatacctatgaagcaggcccccttttccctcttttcccatcctgggcagcctctcacttactctctgtcactgcaagttcacctctcgatacttggtacaaatggagtcgtgcagtgcttgtcttcctgtgtccagatccttgccctcggcgtgaggtttttgaggttcaaccgggttgtagcagatgtcggaattgccttccttttcatggctgagtaatatcccattgcatgcatttaccgcatctggtgtgtctgctcctccagggatggacactcgggggccttcccccttttagacttgtgagtgtgctgctgtgagtgtgggagagcgaagagcttttcagcagtgcagagctgagacagcccaggtgtggggaggcagttgcagaggctacaggtgagcccggcctctgaggttagcatcacggtgtgatgtggcttctcccttccccactgggcccccatctccctcccctcccaacatgtgcatccctgctccagccctcctttccagaggcctgccctcctgccccactcctcctcaacacacccacaccctccacgtgactcacctctgcccagaggcctgggctctgccacctgcaccctttgcagtcccacagaagggaaaggaaagcctacttgctgtgcccatgccaccaaggccttttccatgcacacacacaaactccacgtggccacactgcactgctcacagagctcgaaggcgggtgctgagagtcagcagagccggttcccacagcatcacacccacccagagtgccctgtgcagcccctccagtttaacttggctgaggcctgaagcaccctttatgcatcttttttttctttttttgagacagcgtcttgctctgtcacccaggctggagtgcaatggcatgatctcagctcactgcaatctccatctcccaggttcaagcaattctcctgcctcagcctcctgagtagctgggattacaggcgcccgccaccacgcccagctaattttttgtacttttagtagagacggggtttcaccgtgttagccaggatggtctcaatctcctgacctcacagtctgctcaccttggcctcccaaagtgccatttaggcttttatcccctgaggagcggctgccactgccccaggacaccctctctgtccccctccctctaggcggggctcagatttcccctctgtgcggtatcctgggtgctttgtgcacagctctgccttccccccagcagcggggctgccttctctctaatgctgctcctccccattagaccaaggctgcttcatcccaaacagctccttgccccaggggtattgccagaggggatcagaatacctttgtcattcgggcaaattgaggttcccaaacttccacagggcaggagagcagctggggaaaccctgcacccagggacgtgtcctggagacagggcctcccagatatgctgagatgaaggcaggtggaatcagtgtctcatagcagggctgcagggaaggctaatcagaagctcctcatcctgagggagaggagggagaaggaacctatggtctctgtccctgtaacagcagataacacagtcaccatctgccgcccaggcactcatgttctaagctggtctttccatggggctccttcctgaggctcctggcagtagggagggagaggcagagctggtgagggtgcacaggctggcagaggctgtgaggccactttagggccctggcagatggggagcagtgccaggagccggggttcacacaagggaatgtaaccgcccagcaggctcctcctgcctgcagcacagacaaaaccagttcactgagcccatggtattgcagtcaaaacagagtttaattagagcccagccacatgggggaactggagttatcactggtcagtctccctgagggctcagaggttagttttttccaggatagtttggtgggcgtgggggctagggagtgggtgctgctgattggctggggatgccatcacggggcgtggaaaacggtcctcatgtgctgagtccacctctgagcggggccacaggaccccctaagccgtgagtcgtgagtcatgagtccagatggggtcagtccattttcagaatgcaaaagtctgaaaagcatctcaaaagatcaattgtagtttctataatagtgatgttatctttagaagcaactgggaaagtcactaattttgtgacctctggtcacatgcctcctgagcagtgagggattacttacccagcttacaggctgggtgcggtggttcatgcctgtcatcccagcactttgggaggctgaggtgggtggatcgcgaagtcaggagttcaagaccagcctggccaacatggtgaaaccccatctctactaaaaatacaaaaaattagctgggcatggtggtgcatgcctgtaaccccagctactcgggaggcggaggcaggagaatcgcttgaaccggaacccgggaggcagaggttgcagtaagccaaaatcgcaccactgcactccagcctgggctacagagcaagactccgtctcaaaaaaaaaaaaaaaaaaagaaagtatgcttatattttagccgagttcaggcttctcccatactcctaatctctcagccttttattagctttacaaaggcagtttccacccccaaacgaggagggggattggctttagggaaggaccattatcagccttgctctaagttaaactaaaaagtaaattcctagacacggcccctgcatccaggtctctgctccaccccacccatcagatgtggcttggctcttgcacacccaaaacaactcacacatctcctgtgccaggcctggcagtgccaaccctgcaagtggacatctcagttgtttggcctcagcacactcctccgggttctgtgtttacactgcagagagttttctggaaggagaaagccagttcgccattccctttctagcctctgcttctcgcagcccaagtacctgcattgtaacaaccctaatctgctgaggagaggcactgctaacgtattgacttagagcaagtaggccttcagaagaggaaattaaattgggccagcttccgtcccctcggctggaagcttcagagcaccacaaactcgtgggcccgaaatgctcaaaggcttttatgaaaactaagactttgctgtggtcccataggtaagcgtgcaggtccaagcgtcggctctactgtttactgcctgtgtgaccacgggcaagtcacttaacccctctgagtctggccttgagaccttgtgctgctgtggggagacctgtgagtgaggagactcaggtactggcttcattgctgccactaaggcaccagtcctgctcataagatgagtgtccagaatgtacctggcccggggtcagcccccagtcagtatttggtgaatgagggggaccctgggtgagtgagtcggtttgtctggcctcatctgtaaaatgatgaaatgttcagaatagatgatctctgggtcccctgaagttcaaatacgtgatacttaaatctgtttaaactcagagaggaaggataatttttagatttttagctgagattgatgcacaagcccaggcactacaaattggtaaaaataatccatcggtaaggactccagtgtgcaggaggtaggacccaacgccaacaagcttaagctgaaagaatcattattaactcctgcactggaagagttgcagagcctgggacagcttcaggcatggctggatccagcgccccagcaagctgctccatgtggcctcttggatccactttcctcctagttggctccttccttggtcaggctcttcatcaaggtggccatacagccctgggcacagagagcttcccttttctgcagtggaagtccactggctgtcttcagcctgcctttagttgcatatctgtccccaaactagttgctgcagccaacgtcctgaggtgcccaaagccagggagatgtcatctctacctggaccacctgggccaactgtgaagcgagagggtccctagaggagatccagtgcgacagtcagaagaaggggactcgggcattcaccaccacagctgtcctgcagtgctgataggcagagtttgactaggtggccagaaatttttctggtggaggtatggacagtgtctatgggttcctcagcaggagagctcttcagatgacccagccagagttctgggcccagctccacattccacagcgttccgggcactgtgggaccacgctccagccttcaagacactcactattcatggatgggccctggtctcaggttaagcctgcactcctgcccagaccccaagcaggcatctcagcccctgcctgtatttccagagcccccaggcttccccctccttgagtatgtgccccctcatccataccaagctgtttccgcctgggatgactgctccctactcccgtccctgggaggacagacagtcctccctcccatgcagccctgcatccacgcgagcccttggatggggcagctgtcttctctttcccgggcaggattagctgtttcttcctctgctccagaacatgccacgtacacagctctttgcatatccacctgaggacaggtctttttctctctgagttccatgagggcagggacccctcttatccccagaacgttagcataaggccagaacatagaaaacattctgaagatgttagaggaagggtgggagggagagaaacacatttagacaggaaggaaggaaagaagggagggagggagggaggaggggaggggaggggagtaacaaacatagcccaggccaccggcccagaagcacaagtgactgagtgacccctgagctctaaggggggatggagcggctccagggcccagggagctcagggagggcctaaagcaaggcttcctgtccagaggtgcccggcccagctctcctgtttgctctgcaactactgtcctttcccaggagctctaaaacagttaaagctttaaaacaaaacgaaacaaaatagcaaagctggcctcacacaccaaacaaagcttgtggttttctgttcatttatgaatccacgctgaccgaaaactgattcagccccagatgtgtcgtggggacactaggggcagtcaagttctacccactttgccctgggggtcctggcacagacaagcatggccgccagcccagctcccaggaactgcaagagcaggacctcctctcctggagcagggccctccgacacccaccccggctgctgggacccctcgtgcacctttgttatccccagggtcgctctttagccagagttagtggcagctgccccaggacagagcctccaaataaaaagaggtgctgtgtccccacataggccgcctccttggagcctgtggcctcgtggttccctcgacccttagctcgtccccggagccggctcgccttccccacctgctgagccctgccactgatggtttaggtcactcggcggtcctgggggcttctggggcctacagctgggaagctgggttggggtgaatcaggaggaagggctgccgtcaatgagtagagccccccgctgctccagcttcctagggagagaccagaagcccccagcccacctcactaagccctcaaatgctgtgagcatgcctgctgtctgtccagtgagtctaggaggtgccttggaatctcctgggcccgtatagacagtgcgggtacaggcatggcccttctttggggaggaaggcgcccctcctagcctcctcctccacgggccttctccagttcttgccctgtgctttggggtctagtagtggccagacctgggattgccacccctggcatctgtagcctccttctgggggctgcaagtagtaggggctccagcatgtctacctaggaggggctcaagagccacactgtggttcggagtggggcttgggacccatcttgactgtgtttgcagtgtgggttgtgtgcatgttgggtgtgttatgtctgtgtgagggactgtgagagaggacaggtgggcttgctgctacatgaggcacgggggccaagtccagggatgaggcagggggcacctgagggagtggggagggctgggtcccatgtgggggtaaacctccatagttaacccacggcattattaccattattttccatcatccaatacatttgcacaagactatgggtccagcaccttgctattagaaatgaagctactctgaacactgttacaaatcttttccaacgtctccaatgcctgccttgggataaaacgctagaagcagaacttctggtccaatgacatgaacatttttcacctttgaaatacttcagctaattgacaccctgcagcggtgaccagatacagggctcaggttgcattcctctttcctcctgcttttaaatctttcctagtttattaggcaagaaggtatctcattattattttcctagatgggcttttaaatgactggtctgtgattaaatgcctgcagagctcatggctattttttgcatgggggtctgttacaaggtaaactgagacacaaaatgttagaagagtttattcgagcagacagcaattcatgaatcaggcagcaccagtccaaaggtggtttggggttctgggaagggaacacaaggggaacgtttttatggtgtgaatgtgggagctggacaaagaaaatacttgataagagtatgttgttgccttcttcagtctcaactgttagaaaattcctagttgtattggttttcatgctgctgataaagacatagccaagactgggtaatttataaagaaaaagaggttgaacggactcccagttccacgtggctggggaaggtgaaaggcacgtcttaaatggtggcaggcaagagagaatgagagccaaccccttataaaatcatcagctcttgtgagacgtattcactaccatgagaacagcatggggaaaaccactcccatgattcaattctctctcgctgggcctcttccgcaacatgtgagaattatgggagctacaattcaaggtgagatttgggtgggggcacagcccaaccatatcactagctgtatatctgcctttagttgcatatctgtcctcaagctagttgctacagccaacgtcctgaggtgccctcagtaagttgttggcggcttctgattggttgggcttaagttttatttttctttaatatgggcatttacaagaaatagcccaggttaagttttgtttaggtttgcagaaccagcaaggtcaaggttgtctccacggcttaatgggctttgctcaggggattctcaagcctggtctccattttattttaatgggtcttagtgttttgtgttgatttcttagagcttcttatatattagggatatcatgtttgatcatgtctatggcaaatactttgtctttaattttattgtgtttaagtggttgtgtgctcaaacctccatatctgaggcatctctccttcccattttgagaccaagtaaatattcacccagatattttttcataattttcatggttttatgttttccattaaactctttcatcaaaaaaaaaaagaaagaaagaaaaaaaaaactctttcatcctcctggaattaattctggagcctggcatgaagtgagcttctaaatggatcatttgtttccagagaagttttttcccccgaaaccatctattgatttttaattgctttgtggtgcgtcttaatcatggtttaaattcttacacacagtcaagtctgtctgaagacattccttcgttccacagacatctttactgttgccctagtacttctaaagctttcatttacatcagtttgttacacatttttttcatgtttaggagggcttgtcttattcctctttgttttctaaaatttctcagccattctatgaattttacaatcattttggcaagttcttaaaaaaaagcaaatgctcctgggattttgatggaaacgtattaaatagtaaagggatttggaaatcctcgccgtcttcctccttttcgtctattcatgcttgctcccgggagctggctgtccctctggcacggtgctgctgggctggcagcgctcctggtgcaggtcctgctgttgcttgtcaagtcattcctggcagttttattgcggcggttgctgtgagcctgggtattgtaatggctcgtccctgctctgcccaccgccaatcgcagctcaaggctgaggctcacatggttactcaggcatgttaaatattagtccagcaaaaagagcaacataggttttccccaaaaagcgagccaggacttgccttttttccacacccaatggggagtggctgcccagctcagatgagagccgagtgtccagcactgtggcctttagccccgcaactttcaccaaaaacagaagacagacagatacccatgctcagcatttaaaatcactcggccggccaggcatggtggctcatgcctgtaatcctagcactttgagaggccaaggcgggtggattacttgaggtcaggagttcgaaaccagcctggtgaaaccccatctctactaaaaatacaaaaattagctggatatcgcttgaacccaggaagcagaggttgtagtgagccgagattgtgccactgcactgcagccatggcaattgagtgagactccgtctcaaaaaataaataaaataaaatcagttggtggctttaggtggtgtttggttgttcctggtgtacatgtggctgtggaagacagaaaagtgtcttgaaaatatctgtttgctgtttttaagaatgaaaaaattgtcgtacaatatgggtcccacctttcttctaagtgctccaagtttttaattacagttggttggaatgagagaaaaaaaaaagcacagcttctagctgtttcagctcccgctagtgacaaataaagccagtcctagtgcctattaagtgaaattaaaaggcttcagtgacgccagtttgaaaacatgtgtttgtagggaagagtgaatggcacctgtttacagggtaattaacgtcgcaaccccgactccacaggctgcactgtctcatcatcgacgttcccagggctccctgggtaattattaacatatcacgcgataatgacattgtgcaaaccacaggccgcccctgtcatttctgcggccacagtctctccaactgatgccggtgggctgtgctgcgtacagggctgtctacacggtcctggatgatggataaacatctgccgaaagcctactgtgctggtcacagatggtcaccatcccctgggtgggaaccgttgctccgtttcacagatgagagtgatgagtcagctttatccggagtccgcagggggctccccgggcgctatcccaccctctgggctccagctcgtgttgtttcagacgttcccttcaggcacaaatgcactaagaagccctcgccaaggagtgcagagtggagagactgtgggatgcaggtgcctccgccgtgggggattctccaatgcgctgcacccggcccacagcaggctgtgcacaggcactgctgactgactgggagcttggcccaccccttccccatgccagggagtatttcagaattcacggcttccttcaggctctctgcagcatacgctatcccgggacagcctcttgccaaagggcgggtgataggagcagcttctcagagagctcccaggatggagctgtggtgcccctaggcagacacagcccccgagggaggatgggcttgacaccagcctcatcaatgctgggccggagggtggagggcggggaggctccttgcccacaggtgcgagcctagccaggcttctctgggcgggggctctcagggaagcctctggggcctgtgtccacccatcctctacacttctgctggggtgacccttgtgaaatgcaaatcccatcccctcactttctgtttccacccttcaggggatccctgttatgtatgcgggaaaaatcaagctcactcctgagactggccccagggactctgaggtcctgccaggccaaccccgcggcggtcacagtgggtgtcctcatggcccccaggccctcccccgccgcagtcacggtgggtgtcctcctggcccccaggccctcccccgccgcggtcacatgggtgtcctcctggcccccaggccagggttccctttcgtgctcaggcttcacacgcacagcccggcagatgcccaggagaccttggtggcgggctggtagtattactcatctgacgtccatcactgtagacaaaggttgtggagcatcgcgcggtgcccgctgctgcatttggaaaggctccctcacctctcaccatcctgagtttcactccttagccagcttctctgggatccctccaggtcgccacgctggcagccagtggaggcctttcttcagcacccacttgctcagcaacttgctggcaccgaagggagcgagagagccctgaggtacgggcctgcccttcagctgctcccccgaagcgtgagccagcccttcagctgctccgccagggagagggaggatcaccggcctgggcctttgcgaccttctctggggttgagtctgcaagggttagggtctcctgtgagtggcagagctcagggtggacagggggctgcaggtgggctctgcaccataggagaagctgggctatccccacagaggagggaagcgccatctccacaggtgtggccgggcagaccacccctcccagggccgcgcgtcacgcacaaaagtggggttcacatccaacccactgttgagagtgcaccagaacagcagatttgaaagggctttgacggcagtttccgaccccacccccaggcctctctcaaaccctcgccctgctcctcctctccagccacactctcttccgagagaactcttcccctctttgcctgtttctctgttgtttaacttctagatagggaaatctcaagcatacacagaaggagacagacaagtgcaggcgcatcacactcctcacagttggccttagtgtgcttcgtagatactgtgtcagttacagatggaaggtttggggcagccctgctgtcagtgccattttcccaacagcacgtgctcactttgcgtctctgtgacagcatcttttttgcagcagattttttgtttgtttctttgtttattgagacggagtctcactctgtcgcccaggctggatagcagtggcactatcttggctcactgcaagctccgcctcccgggttcacaccattctcctgcctcagcctcccaagtagctgggactacaggtgcccgccaccacgcccagctaattccttgtatttttagtagagacagggtttcactgtgttagccaggatggtctcgatctcctgaactcgtgatccacccgcctcggcctcctgaagtgctgggattacaggtgtgagccaccgtgcccagccagtaaagtatattctaattgaagtatgttccgtgttttttcagagaatgctttgcacattgaacagattatggtatcgtagaagcatagcttttatatgcactgggaagtcaaaacatgtacgtgactccctttttcaatgatctggaaccaaacccacaatatctccaagacccgcccgtgtcgagaacactcctgcactcgccaccagctcaaccacaaggcagcacggccagtctggcttcatccaaacatccacctcctcccctcccgtgtgatcctcaagcagctctcagacatcatatatagaggtttacaacatcatatcattttattcacaaatacttttaccatatatccctataataactctttaacatatgtattaggattctctagagggacagaaccaataggctatatataaatatataatatataaaaatatataatatagattatataagatacaaaaatatataatatatattataatatataatatataaaatacaaatgtatatataatataaatatattaaaatatatataatatataaatatattaatatatttatataatatatattaaaatatttatatattgtataaatatattaatatatttatatattaatatatatattgtatattaattgtataaatatacaatatattgtaattaattgtattaattacatataaaatacatataaaattacatataaaaatattaatatatttatacaatatataaatatattaatttatataatatatttatatatattaaaatatttatatatatatatatatatatatataaaggggagtttattaaatattaagttacatgagcacaaggaccaacaataggctgggatattgccactactggggatgaggaagctgttccttctggcaaaaaaggttcattagagtttacaagctcagtgtccccagcttcatcaaggtcctcccacacatccccattccaagttgcagagtcccattctttttcggtccatgccctcactttaatagtagacacctggcaaggctgtgcatgcaccttaacttgcaggtcagccactcacatggtaagagcttgtgtctgtttttccacaatttcagctcttcctctacaggagtgaagactctcactcaaggcaatcttagcagacttgagactcagtatctgcttctgaagctgggagacagaatccctgagttcatcattttctttcatcactttgtgcattgaacttaggagcaaccaaccagcttcattatgtttcttggttctccacacatggtcagaggtattatgtatagagtccctaaactccttgcctctcacgagcggtgaatcaggagcgtcaaatgcatttattttgcataactctctaaacaattcacgccaaggactatcagcattctccatactactagaagtagagtccttagcatttttggatctaatcatattaagcagccaactccggaaaccgcaaaaccaacagaagaactccatcctgaatattctgtctctctagaaccactcctggtaccaaaatctgtattagtcagggttccctagagggacagaactaataggagagagagcgagagagatatatatatgtatacacgtatgtgtatacatgtatagatatatgtatgcacgtatgtgtatacatgtatagatatatgtatgcacgtatgtgtatacatgtatacatatatgtatgcacgtatgtgtatacatgtatagatatatgtatgcacgtatgtgtatacatgtatgtgtatacatgtatacatatatgtatgcacatatgtgtatacatgtatacgtatatacatatatgtatacatgtatatatgtgtgtgtgtatatatatactcccatatatatgggagtttattaagtattaacttacaggatcataaggtcccacaataggctatctgcaagctcgaggagcaagcaaggagatccagtccgagcctcaaaactgaacaacttggagtctgatattcaaaggcaggaagcttccagtatgggagaaggatgtaggctgggaggctaggccagtctcactcatttcacgttttttctgcctgctttatattaagtggcagctgatgagatggtgcacaccacattaagggtgggtctgcttttcccagcccactgagtcaaatgttaatctcttttggcaacaccctcacagacacgcccaggattaatactttgaatccttcaatccaatcaagttgacactcagtattaaccatcacaatgtataactacaaagtcattcttacacctaagaaaattataataattgcttagtgtaatcggttagctagtcagcatttgaattcccctggaattttctgctctgacagcccacagttctatccttctagacttgtcagccctaacccatgccactgaaaccatgatgcaaatcaatgagctgctttagaaaaaaaaatttgtatttttaattgacatataataatcgtatacatttatggagcacaaagtaatgtttaccatgtggaatgattaaatcaggctaattagcatctgcatcacatcacattctatcatatttttgtggtgaaaacatttaaaacctactcttctagcaactctgaaatggtgcaccgtgatttcttatagtcacgcgatgcgctgcttgttgcagagtccagtgggtgctcgcgtccccggtcttgccctggcctttgatttgaggccgactccttgcctggtttccagaacactctgccctggctgctgcagctccgcttctctctggggtttcttggggctcagcttttccccgtccctcccccacgtcactctccatcctcagctgcctctggagccacagctcccaaatgagtcccctcccgcctgggagtctcttggggaacccaggcctgcaattcccactgtctgcctggcatctctgccgggcgcacccacaagttccttgacccaacttgtccaaaattgagtttctgtgtagtagccaagagcaagcacttagaagccagaatgcccaggtctggctcctggctctgtccccataaccctgggtaaattactccacctccctggggctcaatctccttgcctgcagggctgcagagaggaccagatccgcagagggccctggaagcagtgccgcaggagctctgcctggggatgaagccgtcgctgctcctccccagcctctcggcagcagcagccacggtggcaacaagcctgctaacatgtgcccttgggagggtgcctccacccaccccaaaatccatgacagaaaccccagcctcagcccaagtctctccaccacacccacgcattacatattgtcagaggctgcttttgccctaggaaagcagagttgaatagttacagtgaagcccttcagtccctcaaagcttaccacccttcatgtctggacttttactggaagtatcgttatgtccaagcctagagaagcagcgtggaccttagagcaaggcagattcaggtttgaatctagctcattatgggggatgtgacttaacccctcaaggcctcggcttgcttggtcccctggtcactgcaactggtggattccaggcccttgccaacaggtccgcctctgtcactcttcttcctgttgcagccccgccctcgctcagaccaccctctgcagcctgtgaccttgcaggagctcctccgggctgggtccccacaccctgtgcactccctagctacagccaaagccatctctctcatgtacagctttgactgtctcactctctgctttcaaaccttcccagagaaacctctgatctctaaagccattcagtcccctggacgtgcggtgccgtctctcccgggcctttgaacacacagcctcttccacctcagctgctggcccctccctgccccttgctctccacgccgtaactctcctctccactgttcaagtctctgcctggatgcacctggccaggggagccctcctaggcccaggcactgcccggggagccctgctgctcacccccacagtgctctgggctcattcccagcacagagcccaccctgagggctggaattgcctgctgacctgcccgtggcctgctctagaccatgcaccacgtgaggacaagtggctgatgccatcccaggcacacagatcctacctcatgagccagtgcttctcacggtacctagtggagaagcattcggagaggatttatctgatggatgttgactcttggctaacaagggctgcctctctccatcccctgactttttaggacaagaccagagatgctaaggccatagctaggaaagtcaggccctggaatgagaccgtctaggcttgaactccagccttgcttcctgttggagcatgctatttaacttttcatcttattaaacagaaataatgggagtggcctccaacgatctgctgtgcaatccacacgggcaaacatgaaacctcctctcccacctggggttagagcagcgaggagacccaggctggccaggacagagactggtggtactttgcccttgttaagagttcttggggccaggcatggtggctcatgcctgccatcccagcactttgggaggccgaggtgggaggattgcttgggctcaggatttgagaccagcctgagcaatgtagcaagacctcatctctgaaaaaaaaaagaaaaagaaaagaaagaaagaaagaaacaattagatgggtatagtgatgtatgcctttagttccagctacttgggaggctgaggtgggaggatcgcttgagcccagaaggttgaggctgcagtgagctgtgatggtgccactgcactccagtctgggaaacagagcaagaccccatctcagaaaaaaaaagttatttgaaaacattcttccacaaggagaaaaagaatggatgcttcgcggtcaaggcctaatagccagccgggctgggctcgtgtgaggctgtaaaaccccatccgcagcttctgtgatggtgtacaggggagcggaatgcctggtgctggcgtcaggctcactgtcctgcagctctttgctggcctggcctgttctccaccctcgtttgctcctgggtcttgtaaacagtgttcctttgaccttcccctcgaggaccagagatcacttgctgtctggcgcaggcgctcctgaccttcagatgtgggaggactgtaagaatctcagggagacccccacccactgcttgcggtggtctcctttgtcatagacgacagatgcttgccacacgcaagcagaggcagggcttaaaggttactctcatttctcaggtgagaaaaagcaaagtgcagatggtttcggagggtcctccaggaatgctcagctcatccgtgggaccaggacgcacaggcctgcccactgcatctaaggcagcgaggccctgtggaatcaaatcagcactgagacagagggctgcaggacgtggtcactgagggcgtgaagccagcctgtgccctcctggcctcacttgccccgtagggcctctcatgtcacgtcacctgcctctgtggaaatgtcctgtagctcctgtttcctgcagggtgtcacagaagcgccaccttctgctagcggcccaaacccatcacacacccccctcatttgcccctcacagagtggtcagaacctactgccagttcccactgcacccctgacagctgtagggttaaaggatggggacaaagtcacaagggtgttggctgggacacctgggccaggtgccttgaattctgccccagggctctttgcacttgacgcaccagctcccagtcaaggcctctgctctcattgcagccctcctgcacttccttcctctgcctcggagcaggatctgcaaacagctcagcggccaagcctagcccattacctgttcttgtaaataaagttttattggaacaccgccacacccgtgcatgttgttggaggctgcttttgccatagaaggtggagttgaatagttgcaacaaagcccttacatccctcaaagcttaacatccttactatctgggcctttacctaaagttgtgcgactcccaccttagagaagcagcttggaccttagggttaggcagatccaagttcatatcgagctcattctgaggcctctgacttaacccctcgaagcctcagctttctttttctttcttttttctttgcttttttttttttttcctttgagacagagtcttgctttgtcgcccaggctggagtgcagtggcgtgatctcggctcactgcaacctccgcctccctggttcctgccattctcctgcctcagcctccagagtagctgaaattacaggcacgcaccaccacgcctggctaatttttgtgtttttagtagagacgggggtttcaccatgttggccaggcttgtcttgacctcctgacttcaggtgatccaccctcctcggcctcccaaagtgctgggattacaggtgtgagccagcgtacccggcctcagttttctaaaaggagaatacagtctttctccaacaggttgaattttgtgtgtacaaactgcatataatgcagttaatgagttaggggctgtggattgcaccatggaggaacaccaccgcttgtgatgctgtcatgatctgtgaggacccggatcttcctgtgatggggactcactgtacgggccaggaagcacacacagtccgcaagccgcagagccggttggctcaagcgtcttttaactttgtttatcataacagtgggtgatgatggctattgagctgataagaaggtggaagcactatttcctgatgatgggaagcaaagatcattactggacgaaatcaaacgccagaattgtctagcagtattgaagtttcagagctaacctttaaaatggaaatatctgtaggacaaatatgtttgttatcgtgagtctgaagctctctggcctcatcctccttttcctatggaaacaactgcttttaaaacagtctttaaagctactcggtttgttagaattgcagctgccatgtcacagcagagcagactaaggccatcccctggggctatggaaggagagtgtcccctgtcccagctgccacacctgtgctgctctcagcccctcacctggagtgctctgcctttctctccacacatccctgtgctcagtcagaacttagagcacacagcaactcctcctcttctgtgttcttgaggcacctgtactcagcgaaccactcaaattaacccatgcacagttctagaattctgtcatcctcactgacacacctgccaataaaaaccccatctctactaaaaatacaaaaattagccgggtgtggtggcgggcacctgtaatcccagctactcaggaggctgaggcaggagaatagcttgaacccaggaggcagaggttgcagtgagccgagactgtgccattgcacttcagcctctgtgacagagtgatactccatccccccaccccacaaaaaaaggccaggagcatctcttagatttcctctgcgtacctgtagtgccccacccagagccaggtctgggtgtgtgtaaagacatgtggaccctgacaatggattatcacctgtacacccacaccatgaaatccaacattcatggcaagggctgcaccaaactccaggcggtcttggagacttcaaaatgtgcagaggcttggctgaggccggcaccttcctagaggagctggagctacagctgggatgtatcagtcagctgttaccacatagcaaatgatcccagtatagcaacctaaaacaacacacatctcctaccttggtttctgtgggccagaaatctgggaataacttaggtaggtcctctgcctcagggtctctgggacagtgtcaaccaggcctgtggtcttctctgaaagttcgaccggggaaggatgcatttccaagctcacccatgcagttgctagtgggattccattgttcgtggacttttggacttgagttccttgccatgaagggcctctccatggggcctctcacaacatggcagctggcttccttagcatgggctggccagaccacaagagcaggtgagcaggagagatggcacaggctcttgttgctgagtcacagcagtgccacattctagtccttagaagcaagccatgtattcagcccacattcaagggaaggagattctcagggcataagtaacaggaagtggatctgcaaacagctcaggggccaaatccagcccattacctgttcttgtaaataaagttttattggaacattgccatgcccatgcattacagattgttggaggctgcttttaccataggaaggcagagttgagtagttacaataaagtccttacgtccctcagctcatgtagggacctgaagctcctggtgggcagggcagatggcactcagacatctggggtgcactgggcaccatgtcctttgttcctagggctatgcacttgcccagacacggggctctgcatttcctgggttgcttgctcaggctctgctgctggctttcttgcacttctgccttgagtcattgctgtctatctccaactctcacttgtccccacctgagtagaagcagggtgatccctttaaacctcctgattcattgagaaggcctcccgagctgcagagtcacccagaatggagcctgtctccaggtccccctgctcaggggagcagattgcgagcaagatttgccaagaaggtaaatgagatcagagaattctatttcccatagttccttaggaaatcagaaagagaatctcaccagtttgctttgatgtcattaaagcaaactgaggaatatacaatttttaaaaaatcatataaagaaaattatttcattatattaaaacattaacattgattctcaaattatccattaaaaccttgctttacccaaacagtcagtcaatgggctacagaaactgaaagtagaaatctggcatggtctatcctggtccagtactgctctagccacagcagatgcctggcatggcacagggaggctccggtgacaggaggcgcctggcgtggcacagcgtggctctagtgacagcagacacccagcatggcacagggtggctttggcaacaacagatgactggcatggcacagggtggctttggcaacaacagattactggcatggcacagggaggctttggcaacagcagacacccagcatggcatggggtggctttggcaacagctgacgcctagcatggcacagggtggttctggcaagagtggacacctggcacggcacagagtggctctagcagtaggatgaccacctgtctggtgtgaacctaacatgcaccccgtgttcccacccttctactctttctccttccatctctatagtcagcagtgcccttgctccctggcccactgtcacgtctcaaatcttccctgttatttaaggaccagccagatgttctactttccaggaaacatccacatccctagctggacatgctctctgggccccgaccctgtccccacactccgcctggcaccgtgattattgtgatgcgtgtctctctctgatgaaacttgtctttcacatctggtgtccacctgtccctcagcccaaggcctagaccctggttaatattcaggaggattttggcagcgttaggctgggataacaaacaacctccaagggctggtcccaccagtagtgctggtccctcccgctgccgccctccgagtgccagcatcttctcttctgctacctgccattttcatcccaagactctggttgggggagcagcccccgtgtgactggccagcctcagggctgctagaagagaaggttccaggccatgtgactctccagaaagtgagttgtttggtcacgtggggccagaggggaaaatgtgcagtcctccctcagttggagcgaccgccagtcacagggccatgtcgctgtccccagatcaaatggatgaccttccgcctggcggacggtgaatgttttgaatgagtgggcggaggctgaatgaatgagcatcattctccctgcagagttaattcctacagctctgaaacttttccctcactctctgaagcctccactcctccaccaaatgccacgtagaaccgttttgttttgtttttttctcctgagatttgagtcacaccggtgcctgtccagctgcctcaacttgcagcagaggttcctaaaccctgaggtgagggggctgcagcccaggcctgccatgcagggctcaggttcaccttgggtctggtgggacatggagttagaaccatgagctgctggtgctctccacccaccagcaaattaagactaagtcagggcagccactgtgtcccagcggctgcttttgatccagctgaagctcgctggccacttagggacggcgagcacagggaggttgggcgaggcgacagaatgccgtccttgctgccgtttggggcttggctgcagcctccagcccaccccttcccgcagaggcaggaggccacgccataacccggctcaggccccagcgcccagccacgcaaggccatccaagcaaccagccagaattccagaacatttcagaaatgtcaggaattccacgatggctgtcaggtgagggtccctccagaagtcctgaaagcttgtctctcattgcctcagcaagatccctctcccaggccgcagaggccccctggcgagggtacaggacccatcacaccaaggacctgagtcactcagctctgcgatggcatcgtagccttagcgtgagaccccagagaaaaccccagctttgcacctttccctttaaatgccagttgcaggcaatctccctagcagcagacgccagcaattgccggtctaaaatgctttttaaaaataatttcatgtattttttttttaaaaaaaaaaagcttccaagctggtatgtatgtcatccttacaccgcaaatgctaaggtgggaaaacaaaaaacgaacgacaatcagatgctccgtgtctcccaaactgcacacgctttacggagaaggagagttgcaccggggcttgtcaatggcagagccttcctgaaagtcaggttctcctgtcagggtggagacccagcggctttcaggagcaaaaaagaagtctccaaaccgacacgctttgctcagcgttgacatatatttctctcttccctgctggtgtcaacaaaaaatgctttgttgcctgcagtaattttacggtccagaagtgccttgctgtagcattgctggtaggcacggcagtgcggctcagctgcctgagacagggtcatgggcctttgcccagctcgtctccaccccagagaaaggggcatgcgggcccctaatttatgggggttcacctggcgctcacagacccaccagttcctacaggcggatatccaagtccagagctgtcgtgggcgcgctgagttgggccatctttggaaagaaaccctggggctgtcgcggggggagggcgatgtctcaccgactaccagggtaatggccgcgctcaattttgcctttcacattttaattgtacaacagtaattttgcaatggagttgccgatggcaaacatgcaaaagacattaactttatttatgttttggattattaatgtggctgttaaaattcctccagttagttttgattgaattgtttttttgtgtgattctgctgtttaatggggcggtaaataagaatttctgataatgaggctgagcatctgtcacaacaacctggtgtgggctattaacatttccattaacggcagggtgggcagtgataatacggaaaccacacagttagaacaaaataaatagttggtgtcaggctgagtgggtgttaattactattttattctgcgctggggggagagagcagaaagtggggagggggtgatggggaaggggcgagtcctgaggtcagtctctcccaagaaggcctctccagagagccgggtgctgggccatctccctcggacagcgactgttttatcgtctccatcgatggtccgtaaagacactcagtcaaaaggctgcactcctgggccgcagccccggcggcaggcggagaggagtgctcggctggcctctgcctccgggagccaggccccctgcacagctgccctggagctccccagggcccagctcatggacagccgggagagccccagtgggaggagggagtagcagagaataggccgtcaagagaaagtgcgcagcgtggaattcaaagatagtgtgaagctggcatggggcagacaggacggaggcgttctggaacgcaggcgtgtgctcccaactgcctaaatggctgtgtggtgaggtgcggaggtgcggccacacccctaatggcggtgtggtaaggcgcggaggtgcggccgcaacatcctcatgtgtcctttggtttgcgtgtgccatgcagccctgcagacgcagacagcaccccagtgagctcctccccagggggagcgagggggctggaggggaagactggatcctcagaacgtgaagccagagctggcctcagagagcaaagtgcagccatgttctcaaacatcggagcttcctgtccctcttagaggggcaactctgtgtatctggacgaacttcatctagatcagggcttcatagccagggatgcctgaacctgtcatgggaacacagctatcttttctctaatctcaatcagtaatattagtgacaaaaaccacagcagtcaggagtcctgtgactccctcgccgatagagccgcagtgaccctgtcacatcccaggcattgctgggacctcaagttaacatcctcacccaccaatgctttgatctcacagcaaccatcagaccagcccctaagcctggtcaggtattaaccaagaagcacgtggattacgatctcatacctttggtttcaaatactctgctaactgtatctcggtataattatttttctgtgcaattctatatattttattgtatgcatttaagaacatcgtatgggaaggatttgtggtcttccctggcataaaagggctgagagctcttagggggacacagagccacggatcccaggacataactgtctaaggcctcctaagccagggcgacggcccagggaagaatctctcacatggttcccagcggaattagggcatgctcgagccccatgggcatgtgggcgagggtccgggccggctctgaatgaacgtctcagcttctctccgcattgctctttcctcagccccggccatggccccgcagaacgtgcaggtgaccccactcacggccagccagctggaggtcacgtgggacccaccacccccggagagccagaatgggaacatccaaggctacaaggcaaggccctcccgtgcggttgcctcccctggctcgcttgggcacccctcgttcacgtggtcctgcctactgcattgccagcagcagaccccgcaggcgctccacctggagagctggggcccaagcgtcggagcttggctagacctggcctgttaactgtggtcacagctgcttgtgggtgggaggcagcacaggggccaggctcactgcacacctggctgtgcccaccacaaaacaacccaggttgggggcccttgtttgtccactggcttctccccactctggacgcatggcctggctggggaacccttccgtttcctgggcccattctggagcccccagtacattggctgactataaaagaacatggggcgcctggaagagaccaggctccccatcccagctccccccttggtcacagttggacactgagtgagtcccttgattcggtcggtccagggtggggcccgccagtctcattcctcacaaggtcccagatgtgaggtccctgggaaccctgctttgagaaccgccacggtaacatgtgagaagcccattgtcactggagggtctagagatggggagaaaggaaggcagcaggccatgacaggagagcgtcgagtgaggaatcattatgtggggctgggttatccatggggcgggaagcacctctccacgtcccatccctgaggcctggcctccttagagagtacagggcccataagcatccggggtctttgccatgaaaacgcccccatccttctcctaaataaattcccctgtctattctgctgggacccaagtcgatcagtcatcagattctgggggctagcctcccctaatgactattggaccgattaaatgtccatttaaagatggtttttgcaggtgtgttatgaaaattaataccttcctccatggcagggctgttacagtgatgaatgagctaatggagagccccatgagcttggaggcatggcgctatttatgtatgtccaaaatatgttttctaatttccttaatgataaagacactgatcttggatattgatctcaagttagcaaggcctgggcgagcggaagatcttagacggtcaattcagtgagcagaagcccactacatcctgcaggtggaaatgaacgatgctcaccagtcagggcctgcccagcaagagcaaggcgggcgggtgtgcgaggcaggcgtgccagccctggggcgctccaggctgcctccccgaagcctccgtgctgccttttcacatgggcaagccgctctaacagcctggccctggtttagacccacagagccaaggtgggtcttctgattggtgttgtctttgggcagcctggctggcactggtcggaggtagcagtggtttccggccagctgtctagggaagcaattctggcaacctctttaaacctttgtgcttgggcgtcaagttcaactacaagcacataaaagctagacaagaggaaatggcaccccagaggaatgaggccttcccagcagccctgagcccaacatagttctcctgcctgttgtttttgattgctttaatctccaaagtatattgccatattgaggaaaacttagatgtcggctctgaataaaatgtgggaacacatcgtaggagttgggggtttgttgtctccatagctcggagcagggggtggacacggggcggcttcccttctctccagaagatgggggagagggagaggccaaaaatcaaaacaccaacagagctaggtctgcaaggaaaggcacatcatcggcagctgaagggcagcttcccttccgtcctcacaacttatcttcaacagcgctttgtttaacgaggcaatgctcatactctaggtgagcaacaggaaaatgttaaacatcgtctcccaaacaacattagcagccaggggtccccgtccatacacagtagcctcagcttctccctgattcctccaggagggagcctttccaccttcccacccagcacagctcgccccagaactcagctcaccccctcgctttgaccttacactcagtggcccccgcttactggaaggcttccccaggacccaccccaacctcttgctgttcctaacagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccggtaggaggaaggcgggtttcctttgggcaggcctccttggacacgtgttttgagagcgccagctcaggtcccctcacacagtggttcccggcccgcccaggcggaaggcaacaccttttgagtagctgggagtttctggatgggcaggactgggtttggctcatttgttctccctgtgcctggcctcagactggtacacagtggcgctaaataaatgttaggtgggttggagcaatgcatgctttttcccagagccctggagattcagaggggaggaagggctttgagtctgcagcaaggcctcgttcataactgacagcatccattccagttcctccaagaaatggaacttcccatcaggggcgcctgatggcatgtccagatccttgggggtaggctcctcgggcagtaaatccaggccacagcgacgggaattcccctgggtctcagggccacagaccacccctggagactgctcactacacacatgccacgggccagtcccgagggctcagacaggtgctgcgctgctgtggcctcatctccacgcacagggcgcagcgcctgttctcagtcgacccctcttccagcgcatctcagtttcctagcagcctggaggatgctgtgaagctgcttggccttgggctctgaggagctctccaaggccctctgtaggattctggaagtctgagagactgggagagtgaggtctgggaaccgtgggcagagacgcagggctcagggccttccgacattccatgggttcagctgacccacagacaatggactccgggaatcagggccccttggcatcaaactctcatgtgctgaccacaaccaggttgcaaggaccacttcctttggcttcatccagtgcccgcatctgagctggaaggatgtgggcagatctgtaggcagagatgagggtagagccatgttgagcactgccggcctggcaggtcacagctgtgggtcccagagactggagggagggcagagagggaggagggtgggtgccacttcacaggcacttctgagcagcgaggggcaccagggcgaggagagtaggtcccccacctaggctgtctggtaggggcagccccagtacacgcccaccttacacggcgcccgggcagagggggagctgccagcaggctccacatcaccccggccacacacctgaccttcagtagctctagatatttccaccagctccctccccgctccagacccagggggacactcagcctggagagtgtggtgggagatttcacgtgcaggagccaggggtgtcccccaaaacccccaggcctctgagggagaggcgaggaggggtcaagagaggcttcatccatcacagagctccgtctctccggcaaagagcaggactagagcttctggaatcctccagcagttgctagaaaatggagctccctgcgtttcattttctatttccatctattattcatttttatgcctttgccgttttgtctctcaagcccctttgtgtttaaacactgtcattttctccactcttctcaggagggtctgcgtgtctgattgatcctcggaagttctgaggtgatcaataaatcttttcattttatgacattcagacttttactgagttgaaaataacatcgaataacattttttattctatacggaggcacagacatgtatgtatatgatctatgtaggagcccctgtaaaagtcactttgtgttctattctcccagcccctggggcccccagctttctggcgttctcagaaataacctccaccacgctcaacgtgtcctggggcgagcctgcggcggccaacggcatcctgcagggctatcgggtggtgtacgagcccttggcccctgtacaaggtaagacccggggttggggagatgggagcgcgggccacaccagtgcccagccctctgcagtctacacagtgagccgcacctgaccgcttctgtgggccaggagccttctggcgcctgaagtggggggttttggaatctgagctggacggggctggagctgagtgcgaggggagcggggactcgcggggaaaggcctgtgaggaaaagctgagccaagaccagacctctgtgttctgagaccagaacggcactctccctctgaagccgtgtcatatatgcccttgatcctgtctctgtcacactcaagacattcctctcctattcctcccgagatgtttgtcctgtggtcgccgacagagaccacccagggttccacttgaagccacgcctcacaacacaggccttcggctaccctcagcatcctaggagggatgctggcatccccgtgtcttagcaccctggtgctcccctcgctcatccgtcccctcagcggacatctatgaagctcctgttctacatgctggaaaagccaagacatgctccagatgctggaatcgaggacctgggaaagccaggattttgactggcttgtttatcaggtccctggctttcctgcgtccaggcagttcctattccagggcagaggtaacacacaggtaattaaatcagcaaacaacagcccgagcgtgatcagtgctttggaggaaagagaggagggctaacacaagaggcttagggaagagaccggagtgacaagggcccggacacacaagaatcctggggaagatcttccgaagggaggatccgccaatctaggggcccacggtgggcagagcttgggtggtgctggtggctggagcttggtgagtggggtgcaggcactgcaggccacagcacacggggctatggcatatcccactggagagtgacacaggagcaggaggacctgacctccccaagaccaggatccctcgggcccaatcccccgtctcagtgtcacgatggaaagaagctatcgttcatctccacacttcctagatcaaccggaaacagcttccatagaagagcagggaaggtgttgccaacacagaggactttgaaagaggaaatgtcaggggcttgacagtgagtgacaggtgaaaacggaaggtggaatgcagatggctcggaggagaacgggtggcagagattctgtagaccagggagtgaggaggccggccggggctgtggcatcatcctacaggagagcggcgagaaggggaagggtgcgggggcaggggaggagggctcagatcaggggtgtgtattgaaggtggagctggtggggtactggcgtgaagtggaggaatgggggttgcgggcaggtggctctgccctgctgtgcatgtggctgctgctctgcacctgctgggtcagtgcacaccctgctcaggtatttgttcttgtttttgtttctgttttttttgagacggagtcttgctctgtctcccaggctgaagtgcagtggcacgatttctgctcactgcaagctccgcctcccgggttcgcaccattctcctgcctcagcctcccgagtagctgggactacaggcgcccaccaccacgcccagctaactttttgtatttttagtagagacagggtttcaccatgttagccaggatggtctcgatctcctaacctcgtgatccacctgcctcggcctcccaaagtgctgggattacaggcgtgagccaccgtgcccgacccctgcttaggtgttattccagtgccttctgtgtccctctctcctgccatccagacaccaatgtgtccaccaaagattccggtctgggaggcacgtctttcccaccacactggggtgaaatacaagtccagctgtctctgccttatggtccagggcaagtttccccctgtaatatacacagacagactgtaaaaattatagattatttaatgtctgcgaggaaaaaatacaacgagcacatcaaagaatatcggcgctccatttaaagccgtgataaaagtttcctttaaaaataagcacatttagatgaaacggagttgatttgatgaagaaaatttaagcactagttttttatttcactgaatctcagatgccattcactgtaagattcatcattattttatgaagtgctcagaaagaaaaaatgctcccaataaaccagagcccaatacttttgtatcatcaattctgagctgcatcccaaatcggagatgtgaaaatccgagaaagaaaaaaaaaatcacgtcttagacaatcgatggactttggtaaataacagtagaggtgagatgtgggcatggtttttgaaccagcagagagggcatgggagggacggggatttagtgtggccacttcgaggggcggccaggatctgttgtgaccttccgagtgcccagcacctgcctgggagccagggggcctggacgaggctgccttcgaggtcccacagcagaggcccagaagcaggcatgccatttgctcttgcttgtcctgcagggagaaacagtagagaattttggagacacacacgggttccatgagcctgtgttacaaatgccttttcaagggtcataaccaacgaggaccatttaaatgagaattgactgtgaaagcttcatagttctgattgacctgtgagtccttcctaatcaaaggcagctcaggttttcccattcttcctcaagtaagtgactggttctgctccccagtcttctgtgttaatggatttgcagaatctccgtggaaactccatggtgtgtgcctctgggcttctctcttgggctgctgctcttagtcttgtgagaaagtgcttcatgggctgggcgcaggggcctgtaatcccagcactttgggaggccgaggtgggcggatcacaaggtcaagagatcgagaccatcctggccaacatggtgaaaccccgtttctactgaaaatacaaaaattggctgggtgcagtggctcacacctgtaatcccagcactttgggaggacgaggcaagtggatcacgaggtcaggagttcaagaccagcctggccaagatggtgaaaccccatctctactaaaaatacaaaaaattagctgggcatggtggcacgcacctgtaatcccagctactccagaggctgaggcagaaaattgcttaatcctgggaggcggaggtggcagtgagccgagatcgcgccactgcactccagcttgggcgacagagcaagactccgtctcaaaaaaaaaaaaagaaaacaaaaattagctgggcatggtggcatgtgcctgtagtcccagttactcgggaggctgaggcaggagaatgggttgaacccgggaggtggaggctgcagtgagctgagatcgcaccactgcactccagcctggtgacagagcgagattctgtctcaaaaaaaaaaaaaccagtacttcattccaggcaaggccattccatgggtcattacccagtcagaagtgccgcacaggggcctcgatgtgttgggtcctcttctctctgcagtttcactcccctagaattgtttcttggcttctaccaaaccttccccctagcccagtctcccagacacaagaccctgcacatctggcttcccttgtgttttcagtgttgccgtttcttgttcgtttcatgacagtttttgcatcactgggaaactcaaagcattcggaagatttttagacaatcctttcagcatgtcccgcttacatgggcattctgtgttctcgctatacacaggcaccccccaggtataatcacagtgataggtgatgtttgttgagctcaagtcgggcactgtgctcagcacttaacatccgctatctccaaatcctcagaacggctctaccttgtggctgcagcttttcttctcctcccgcagacagagagattgggctcagagccacaaagacatttgcccaaggcctgcgttttgaaaataatgacgagggttgggatttgaacccaggtgttctgagtccagagccaaggcctaaactgctccatgatgggcagaaagcgtctggagcacttgtgtttctgaaagtaaatgtgaaggtgaacttcagagatggggcttgaggaggattcactaaagcgttttatattctagacaaaccgctggctgcacagccgagtagggggcctgtctctcccctggatggcaaaaggtggagtcactttagtcacaaccgttttcgcctcttttcacaaatagcaagaccgtccgtcaccagccttgtctcttttgtctgttgcgaagggctggttccttcatcctggattttcctggctttgcaaccgaggcaatgtgctctgagattagagcgagaggggagcagcactgtcttgctttgcagctccttccttggctctgcaggctgaggggcggccaggatctcagcagaaaaagctccatcaggcctccccgggtgtcaggaagaacaagccatgcagaccccccacgtttgggcttgctgggggcttgggcacgttccagacttcggattcctgcacatcagtcaagcagcggatccaggtgtggattgcccagcggtgctggtgacatgaggcgtccagcccccacccaatggccttatagagcttcctctagacatgacacctggctctgactaagccatggggcccccgccggggtctttcccgccacaacaccgtcagtctgcaggcaccatcatccgtggtccggctccagccgggatgagcctgagtctggctataggttccagatccctcctggcttctccctcgggcaggactcagcaaccctgccccccagtgccacccaggtggacctcatggctgcctggggaaggccctcctcaccacaaatgccagcagagcctcgggaccctggcgctcgcctgcctcccctgatggtattggccagaaccctggctcgccgagacactaaccccaggcctgtccgacaagccacatcccgtacccacatacgtcaaaagaagaacgtggaccaagagaggatggcagatcagactcactgagtcagcttatatctcatcgggggccagagcactggcatctgatgaagattcccaattggtgggtggtgaaggtggaggtggcagaggcggaggggcctatctctcccttctcctgagtccaggccttgggcggagtccccctacaccgactctgcgctgggccacgggattcgcttcagccagcgggacaatagctgtcatgaggcaagcagcttcaaaagcatttgcacgtgggaggcaccctggtcctcctgctgcccttggaacccaaccaccatgtgaacacacctgggctggcctgtggggtgacagtcacgcacggcccagcatgggagaggggccacctgggccagccaacccccagtgagactcaatgtgtgaccgcagacatgctgagtctagtgcaggccagcccggccaaaggactgccccgcggtacgggagctggtttggtggtggtggttttgagccactcggttttggagtggtttggttcacagccgtgcatgagagaggtacagcaggtgaggagtccatgttgattgtggagcacctattacttgatgcgttcttagacaatagtcagagttggggtcctgactatcggctgggcactcccactcatcccccctgccctgctccactcctcaccgtggtcctatgaggtaagcgctgccaacctcagagcagagggagaaactgaggactctgcagagaccacatgtcctgcccagcctcacacagggagcaagcagtgggcttcagaccactcccatccccgttcctgcattctctcttcctcccagctgactctgcagataccacaaccggccttggcaggaacgtggttcaggaagcactcatcctggcagctgctctctgcctgcaggcatttctgagtgtcttggcctcctgaggctggggaagggaggacgtgaactctctgttgaatgtgggaggatgccgggatagcttgaaaaggacgacaacgccacacgatggagtgtggccaagggcagggtggttgacagaaggcaacgactgggaaaaagcaaagcagcttcgtgcaccccgtggaggttacaccatccagccctcactgccctgcacctccacacccagactggccccgccccacggccgctgctcccactctcacccggaggggctgcactcccgtctgctcctccccgaggcccctaggagacaactgtgcctgcgtgggggactctgaaaaatccagactctaaccctttcactattgcatcaggattcccaacggggaaccacaaaagcggtaactggacctccacatgactttcaatattttgctcatggagtctgtgcgtgtcccagggaaacagttgcaaacgcagtgaaacatcaggcatccttgaagtatattgtgatgacaaaatattttaaaatatggtaaagatagttaaaaagtaaacagtgatctcacctggtaggggatctgtggggtcttctgacctctttccacacctcctcacccagaaccaggtctgtgcctgacatctgcaaactcttggctgggcattgaccagtcgggccaaggcaaatagagggtacagcatttacccggtatgggcagctcctctagtcactccactgtgaacacagtcgtggctcatcctgtgtgctgggcagagcccagggccatccccagccatccccgtcactctagggaacactcctcgaacccctgggacatcacattgtccagagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccaggccacccggagcaccacaccacccggagcaccacaccccccggagcaccctgccacccggagcaccaggccacccagagcaccaggccacctggagcaccaggccacccggagaaccacaccacccggagcaccaggccacccggagaaccacactacctggagaaccaggccacccggagcaccaggccacccggagaaccacgccacccggagaaccaggccacccggagcaccaggccacccggagcaccacaccacccggagcaccaggccacccggagcaccaggccactcggagaaccacaccacccggagcaccacaccacccggagcaccaggccacccggagcaccacaccacccggagcaccacaccacccggagcaccacaccacccggagcaccaggccacccggagaaccacaccacccggagcaccacgccacccggagcaccaggccacccggagaaccacaccacccggagcaccaggccacctggagcaccaggccacttgagcactcagccatgtgcttgggaatccgattttatggcagagctatttttacattttttaaaatgtttttaatggtggtggtttatgggattgtaccctgaggctttgtagtgctgggcatggtttaaaaattgattaaataaataaaattctgacacacctgaaatggggagaaggccaggctggctctgcctcctgtgggatagaatttacaaaatctgtacctgggtttgtttttgctccagggagaaggaaggcatttttaacaatgaaaaaaaaagttgctctctagaatcactttacattggacaggacccagtttgtgtgttgatgacagtcactatgtgcacaaactgccatcctcatcacctctctgagcaatggaaggtcagtgctcacacatgccccattcctctacaggaaaacccagttttggagggtcacccaaaagtagccaaaattggccccaggcacggtggctcatgtctgtaattccagcacgttgggaggccgaggtgggcagatcacttgaggtcaggagtttaagaccagccgggccaacatggtgaaactaaaaatacaaaaattagccaggcatggtggcatgcgcctgtaatcccagctactcatgaggctaaggcaggagaatcgcttgaactcaggaggtggaggttgcagtgagctgggatcgcaccactgcactccagcctggatgacagagcgagactccgtctcaaaaaaaaaaagccaaaattgctctgaaataattcggaagaaaataatttagctgaatatatgtttgataaaaggcataatatatgaaaacactgaaccagctagaagatatgttggagatttttaggataagagaaatttgctttgatggctttgaaagatggacccgttttgtagtaggaaggcgctttgttctgttctgaagtggagatgactggggtattccaggtgctgactagcagcgcacgaccctcccgcaccaaggcagccatttcttagggctgacagcaggagggcagggctgggcaggtggactcaggacggtgggtgccactcaccaagggcagctcttctcagggatgctccttggaaaatgagctctgccaatcggtccatcctggaagtaccacaccttgatatcctcctccaagagctgcctggtggagattaatctattgaaagttctgagaagtccagcagttgagaacttatctaactgtttttttttttaatgcatcattttcaaacttgtttaaccaaagaacttgatttttccttctggaaaatgctgcatatgtgtaattttcaatatttattctctcccctaaaatgtgaaatctccattttctatttctaggtaatccaaccagcaagacttttgcatgatcacttgtttataacatcccataggtttgaggacgtttgtctctatgttgccatcgtcctctgaatcgaggcatcaatacttgcagtgaaattaattaattttttaaatcctggcttcagagtccacagatgaagttcttatgactcatttgaggcctgtaggccgcaagttggccaacccaggcaggctgcagcctcctcgtggggtctaactagatggagtatcttcctacatcttgtatacgctccctgtgttaatctgttctcacactgctaataaagacatacttgagactgggtaatttataaaggaaagagatttaatggactcacagttccacatggctggggaggcctcacaatcatagtggaaggcaaaggagaagcaaagtcacatcttacatggtggcaggcaagagagcatgtgcggagaacctcccatttataaaaccatcagatctcatgagacgtattcactaccacgagaacagaatgggagaaacagccctcatgattcaattatctcccccaggccccaccttgacaagtggggattattacaattcaaggtgagatttgggtggggcacagccaaaccctatcactcccctccctcgtgactatgtcaggaagcttgcagtcaccttacaagtgacaccagactttgcacagctcagagccaagtgggaagggacattccctggagtgtccaacctggagaatggcaggaccgccccccttcccccgcccccgctcctccctcccctccccgctcctccttcatatcattcctgagacggcagcctcccccttttgtgttgtcagcctcagttgttttctttgtcagcacccacttaccaagcttaagctctaattacacttatctgtgctgaaaattggctattaccaccatataaactcctaatagtaagaaatacttccttagcaaactgcagggaccactttccttgttatcgcaacagaacagacagtggacagttgcttctccaggctgaacccccttgtttcctttgcttctggcggctgcaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggtaagtggaactccaggggcagacaatgtcaattgcaactttagcctcccgcctcctgcttcactgagctgagatccatctacatggtcaacaaggtgatgttggcggccaagagctggcatcaactcggggatgtctgggcaacatggacgtcttcaaaagcacgcgtcaacatggagtttgcaggtggacttgttacatccatgggcacattgttaaatattaagcatgtcaagttttagttgtttttttttttttttgagaaatcttaagaggaaaataactgaatttggcatttgaaataaatcagaaaattttaaagttttccaggtcatggggaagaagcatgtaccttcccacttatccaactgttctgccctttgtttaaagacaggaaggcgtgggctgcagaaccggcattcagggagtgctgcttagtcccgggcacagtgtggggtgccctgcacctgccagctctttcaggccctcttcaggtttttttgttgttgtttgttttttgagacagggtctcactctgtcacccaagctggagtgcagcagcatgatcatagctcactgcagcctcaacctcccccggctgaagcgatacccccaccccccaccccgcctcaccctcctgagtagctgggctacaggtgcaagccaccacacctggctacttttttttgtattttgtagagacaagtttttgcaatgttgcccaaactcctgggctcaagcgatccacctatctcagcctcccaaagtggctttcaggcgtgagccaccacgcccggccttgcctccctgttattaagatgaaaaaccctgggtgcgtgaggttaagtaacctgcccagacactctgcagcctcgaccggtctgaccccccactgtgaaatctcacggggtgggatgtgagccccgcagggctgatgcctcacctctcttttcttctttatcccgcaggatccccgggctcgcctagagatgtcctggtcaccaagtccgcctctgaactgacgctgcagtggactgagggacactctggcgacacacctaccacgggctatgtgatcgaggcccggccctcaggtagggtggcaggccccacaaacggggtctcagcccagcggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccgacacatcgtttgcttcattttttaggcttccgaaaatgaggtctaagatccatttccagccttattcaccagaataatttttttcacccttccttccatttgcctttaataactaaggatgggcattattgggaaatgagtttctgatcgggtgcgtcggatatgactgcttggagctagtgggtatcacctaacacagaaagcacggaacagctccaatatgaccttcagatggttgcacagttaatcatgaacatctgagcatgaaaatatgtgatgtgtcagggacgctattcaggaagcaaaccatcaaaccccacctgccaatctggcaggaccacggtgctaggaactagtttagtctaatacttaaacaggctattagaccaagaggaaagaccccaaagctacatctgtcactgtgtcaggacactcgttccctcctcccccaccaaattgcttttgaaagattattagttacaagtgctttctagaaacttctttattttatttttttgagacagagtctctttctgtcacccagcctggagtgcagtggtgcaatctcagctccctgcaatctctgcctcccgggttcaagcaattctcctgcctcagcctcccgagtagctgggattacaggcacccgccatcacgcccggctaatttttatatttttagtagagagggggtttcaccatgttggccaggctggtctcaaactcctgacctcaagtgatctaccctcctcggcctcccaaagtgacaggattacaggcctgagccacggtgcccagccgccttctagaaacttctaaggagaaacctagtgcagaagcgtgaaaaagccaaaggcaacataaacatttctttggctcaataactcagaaatccagacgtgctcgcctgggggaccctgagagtatcttttgagcagggcgtctgtcctgttgtggaaacagagggtcctgagttggtaaaggatgtgagtttggcaggggcctcctgtggtcactgcctgtgaaagcccatggcccctcacacagccagctggccctttgctaatgactttgattcaagagcactttcagagactgacaggagctgagacgtgtgggttctggggccaaattgaggctttgtggaggccaagggggagggagctggtggcagggagcagcccagacttaagaaaccacttcagacactttcctccccatatccagggagagcaccgatttcttcctcaactcttccagcctgggtgacagagcaaggctccgtctcaaaaaaaaaaaaaaaagtttctagaaggcacttgtaactaataatctttcaaaagcaggttggtgggggaggagggtacgagtgtcctgacacagtgacagatataacaaataggatccaggcgttcacaaatagaattcaggagatccgtgagcttggatggggaaaatacacattttattttcactgacctctaactagaatttggcatttcctgtaattatggatgcaggcacattcgttatccagggctgccttagcaaagtcccacaaactaggcagcctccacaacagacatgggttgtctcacagttctggaggccggaagcccacagtcaaggtggcagcagggcaggctcctcctgaggctgtgagggaggatctgtttcctgtaacctctcccccacttctggtgattacaggccatcctgggtgatctggggctgacaggtgcttcacccatctctgccttcatcttcccatggtgatctccctgtatgtgtgtctgcatctcagttttatcttttatgaggacgccagtcatactagactggggacccactctactccggcaggacttcatcctaactaattacatctgcaactaccctatttccaaataagctcattgggaggtattgggggttcggacttcaacgtatgaatttgcagtggggggcagagacataattcaatgcataatattagctaagaaaccacataactcatagtaggccctgtgacacttccaggagtactttcgtatgacttccccgccattgcagatatttcacaatgctgtttagatgtgtccttacgttgaaatcacagtcatttgtagactctctgctggaccttgttggctaatgagtccatgaagcgtagacttttgagttgtgctgggataacggtggccacaggtcacctaaacccaactcttcatacgtcttccaaggaaccacgtcgctaaacaagttagtgcaaagaaaaccacccataatccatgcctccagcattacctggagacacgagttcccaggaacctgcaggtgcctccaggtgatcgtaggcattaccagttctgtgactccgttctcacattgccataaagaaatgtctgagactgagtaatttataaagaaaaaaagtttagttggctcacagttctgcaggctgtacaggaagcatggtggctttgcttctggggaggccccaggaaatcatggggagaccccaggaagcttccaatcatggcagaaagccaacagggagccggcacgccacatggctggggcaggaggaagagagtgagtggggaggtgccacacgtttttaaacaaccaggtctcatgagaactcactccctattgtaagaacagcaccaaaggggtggtcctaaaaccattcatgagaaacccactgctgtgatccaaacacctcccaccaggcccctcccccaacaccggggacgataattcaacctgagatttgggtggggacacagagccaaacaatatcaccagtagaattggtttccttttcaattttagtttatatatctacaaccattctgagaaagtgtccttgagccaacagatcgccacagggacccatggtgccgagagcagattaaaaagcctgtaatcccagcactttgggaggccgaggtgggcggatcacttgaggtcaggagtttaagaccagcctgaccaacatggtgaaacccagtctgtactacaaatagaaaaaaattagctgggtgtggtggcatgcacctatagtcccagctactcgggaagctgaggcaggagaattgcttgaacccagaaggcagaggttgcagtgagctgagatgacgccactgcactctagcctgggcaacagagtgagactctgtctcaaaaaaaaaaaaaaaaaaaaaaaaaaaaaaaaaaagacacccgcactagaaaactacagaagggcctggctacgaaacttcctcctccctgaacgcctgcctccctgactacagattaaggatcccagcagatgggtggctgtcacagggtcacagaaggaggcattctggatctcgaccgcatccctgcccatgtcccagttgtgagactgcagcacagttttgcaggatgttaccactgggggacactgggtaaaggatacacagacttgctctccgttgtttcttacaaccgcttgggactcttcaactacctcaaaatgatatgtttagcgtcaagtaatcattgaaaaagccacggtgtccgtcctccccagcctgctcggacaagcacaccaatgtgtctttgagcactcttgtgtgggagagcggcctgtgggatggggcggtaccagccagacacgggtgcctgggctcagcctcttaacgctgtgaacacatctcagcattttccaggcagcgataaggcattggttctcaggcttgccgagagagcccttgactttctcctcaggttctcatatgctgctccgccggctgcacgaagggaacaggacgcctgttggttactggtgcggcccagggagcctggcaggccgtgcggattagaagtaattggcgtgtcggcgagggcttcacactgggcccacgcctcagagtggcttgcctaacatggagaagcttctgaagtcagctgagtctgagctcagcagggttggggccagtgtgtggaaactgacccacaggggaccaagatgtgacaacagacttatcaagaagaccccagctttttcggcgagggctgaagatcctgcacttaattctgcttggctgctcaacattcaaaagcaggtcgccaacgatctcccctttcggatcatgaagggaacccaagcaggccgcgggacccgtgttctttcatgggaagttgagacgccccctcccttcaatgattaaggccagcagcagctcaggcaaatgaaacgctttatggattgtcaatatttaagcaccttgctggtacctgagggctttggatctcagctgtcatccattacaggcctcattacacaaaacattaaatgctgtatcatctcattttcccaccgaagctccctggcaagacgttctccaggtggggtgtggtttgctccaggtgcaatgaatgggccccgttttgtattgggaggggccacacaggggccctcaccgctgggtatctgggagacgggcactcggtgccaggcagcccctctggcccacgtggtcggctcggcctgatgtctctctatccagctgagtctctaccttgcccctgggagacaagacactcatcagctttgttgctgctttgcagagggtggccagcgggcctgggcagcccgggcagatggtagtggagcgtgctgccctcccatccccatccttccttacaccccccgcacattctactgcatagcccctgttgctgtggccatgtggagacgcagaactgagcagcagctaatgaaattagcaccaggctagaacacagatcccctcttattcctggagagggcgctccatgagtgtgagcccaaggacaccgccaccagcttccaccagcatggcctggcccacacgttcctttctctggctgtgcgtaagtttcctccaaattggtgttgcaaaactccctggaaggcactggaaactatgcactggacatatgcagatgatctatttacacagattattctaaggcattttactgggtagatcatgaagcctaatttacatatttacacaatagactggaatgacgctaaaggaactataaatatattttcctctccaaagcagccatgaaatacatatttagaatgtgcccaatgcaggcagatattgtattgcattttttttttttttcttaaataatgtgtgtagcccagagacgagggcaggtggctggaggacaggtcccgtgcctgatggggacaccccccagccggaggcctggactgctgtccactcgtagtcccctgggggctttccagttccctccccattgattttgttcaatttcagtctttggcaacgggagttttcaagtgagtaaggaagaaaatcagtatttctctgaaggtttgacatccatagaagttccaagtcagcaggttcagcaagagggggctgttgccatggctctgatggtgcccggtcccctcatgtgctgcttgtctttctcataagctgcttgtctttctcataagcgtgtttctgacagcttgtcagcccggcttcccaccccttcctgggatcagcctgcaacacgggctttcttcgtcatcttaacatgcaatgcattttgcctcctgccttgaatgaggatccgatggaaggtaactgtcttttttttaaatcagatgtatttagcctcatgtttaagcgccaccagcttcagtaaaatttctaacctggattggccattcatacaaaaagaaatggcagtatttaagaaataaacaactgacaggcttgcatttgctctgagctgcagactgacagtcaagcggttggttgtgtgagtgcgtggaaccagaaatctcaggcagtgaatgacggtttcattcagcatggagaccctgtttaattgtccatgaaatcaaacttttgtattggcatgacgtcggccctaatacctgcagcacgcagctccgttctgggcgttggagggataaattgagtgcagacccttcgacgtgctgcgctgggctccagctcaattcagaaaagaggtgatcatgtttctgggtgtattaggacattgtctgggaacagatgtgcctcctaccgcttgggcggggggagatgctggcaccagaagctaacagctgactcattctgtcggctggagacaagcatggatggatagcagaacctatttatacagaaaagatttcttttttcaaggatcttcaatattagccacttacttcccttgtttaagtggacaaatcacgccgtaaaaaatgaagatgcatagttcatattctttaaagaaaagccgcctcaatgggaagctgaactggctcttgctttttcccactcagccttccttctgaggtggacaggattggaggttgtggtgacagcgtggcttcttcaggaatattttgcaaagtctctttctcagtggcttcccactttcttagtggtatttctccaatggcgtttcagtaacaagagtccaggaaggtgctctttcgggcagccaggaatgaaagaccaagcacgatagacaggtgtgatttgcagtcacatcaccatgagggcacctccgccctccacagacatgaagtggcaggtccagcccagaggtggacattacccacaggaagttcaaaccctgggcctcagcaggggacttgatgcctgcatcagtcattttgggggatcagtgatctggggatgtggctttttaggggacatgactgtcctcttccagccgggcattgcttttctcttttctttttgaaaccgagtctcactctgttgcccaggctggagtgcagtggtgcaatctcggctcactgcaaccttcacctcccgggatcaagcgattctcctgcctcagtctcctgagtagctgggattacaggagcgtgccatcatacccagctaatttttgtatttttagtagagacggggtttcaccatgttgatcaggctggtcttgaactcgtgacctcgtgatctgtctacctcggtctcccaaagtgctgagattacaggcgggagccactgcacccggcccttgcttttcctacaacggcaacacagctcgttcactggggaagagaaaccaggctggctcttccggacatcccagagagctgaccctagcctgggtgattgacaagtggctgactgtgtgcccagaattgcctttaaaaaggatgaggccctgctgtcctctcgagtgttgactgagatggaaatccaggcactggggactgtccagaacatggaaaaattggttgcataaatctcatttttgctaatagttctgtaatgttattttccccctaatttgtagagatacttttctccatcattgatttattgagatatttaacagcataatacaaatgagaaaaacaatccacagttgagaaatagagtggacgccttaccagctgccaaatttttttcttacccactcgtgatcgtggtgtaaatattagtacgagataagtagcccggtgaattatagctagagtggaaaatatgctaatttgggaaaggcagaagtaagcagaataaaaatgggaacattttcttctgttaattcagaaggaaattatctcggtatgacattccccctcacccaacatttttgagtgtaaatggattgctaaataaatcgttctgcgttaagattctgtatcaatattttaaaatgttattatgaaaaatgcacacaattcctggagctatgacagagtgcttaaaataaaatgtggcctttaggtgatggtacaggaagggagaatcattttttttttcctcaggagcaggaaagcattacagaaacattaatgcaaaagacattcagagaatccactccggaggtgttcagaccttctcagaacagtctgaagaaatccttcactttcttagtcccttaatttcaatggctttaagcaacacccagtttataagagtctgtatttggtctttagtgtctattacaacataaaattgtctatctttttagaggaaaaatacaattcattcaatatataaagcccttaaaatagagacttgctcacagtaagcagtaaataaaatagtggtggttattatttattgaaagcctgctgtactaggccctgagaaagcccatgggatacaaagaggaatgcaggggttgggggtgggacagatgggtggatgggtggaaggaagaatggatggataatggatggatggatggatggaaggagggggacccagaaggaaggaaggaaggaaggaaggaaggaaggaaggaaggaagggtgggcaggcagatggatgggaggtggatgagtgggtggctggtgggtgagtggatggatagatgaatggaaggaaggaaggaagggtgggtgggtgggtggattgatgggtaggtagatgagtagatgtgtggatggatggacgaatggatagatggataggtggatgggtgagtgggtggatgaatggatgaatggatgggtggatggatgaatgaattgatgaaggaaggatgaatggatggatggatgaatgaatggatggatgcctggatggatagatggatggatggctagagggaagggaagggagggcaggggagggaaggggaggaaagggaagggaagggagggcacaggaggagagggaaggggagtggagggcagggggaaggaaggagggagggaaggaaggaaagaaggttggttacatggatgaatggaaggaaggaaggaaaaatggatggatggatagaaggaaggatgaatggatggataatgaatggatggatggatgattacttaggaagatggatcatggaaagatggacagaaggatggatggatagatgatagctggagggaaggaaggaagaatggaatggatggatggttacatggatggatgggtggatggatgatgctaagcctgatggtgtgaacagccaggtaaatgtgctgatgtgatttagaagcccattggtggaagcagtcatcccttcctggaacgtggggtggggtcaaggttgacctcaaaaagatgagtctgagggggcaaaaggactcttgattttcctccatcccctgtccacaggctgtgcgtaagtcattagaacagcaatctcatctgattccctgatggatggcacagggtctgatcaaagagtagaccgcatttgtggatgaataagggagtgaggcaggggaggagggggcaacagttctccaggtccagaggaggcctgaacagagtaaatgcacaagccttccctgaccattcttaagccaaactcacatacgacaatataaaccacatacaaccagcataaactacatacagccagcaatctgtgtgtgaacctcagcatcctaggagaaagaaggtaggcttaggctctggcttgccattctgacattattagtggtgatgagtgtcttggtgagaaatggctgtaaatgagaatatttagaaataatggccaggcatagtggctcatgcctataattccagcactttgagaggccaaggcaggcagatggcttgagctcggcagttcgagcccagcctgggcaacacagggagaccctgtcactacaaaaaaaaaaaaaaattaacaacttagccaggcgtggtggcgcatgcctgtagacccagctatccaggagactgaggcaggaggataacttgagtccagtagtttgaggctgcagtgagctatgattgcaccactgcactccagcctgtgtggacagaggagggcccggtctcaaaaaaaaaaaagaaaggaagaagaaagaaagagcaagagagaaagcaatcagagagggagggagggagggaagatcagtattatactacctttctgccggtggagagatttgtacctttaaaatctcattcacgtctattcctcattaacctgtgactgtaaggacttagtcggtgcacattctaaatcctctgcaaatacagacagatacaatagcaattttctgcctatttactgttgggctaatccatctgagtgtacctggtgattccgggtgggtgataaggttggtttccggagcagtctcagtgcccataaagtagtcagcacgggtacacacatatccaaatgggttttccctcaccagattccctgctttgtaaaagatctcatagctgcacctagaaaagcaaatacagttcatgaaggattgctacttcaaatgaacattttggcctctgagcctactttttttttttttttttttttaaccaaacagcctccttagaattgaatttatacaaacacacgtacagcacttactatgtgtgaggcactgtcctaagcactttataaatattaacttacttaatcctcaaagcaaatctatgatgaagatgcctttgttatcaccattctacagacaagggtcagagaggttccgttctttgtctaaagccacacagctaattgaattggtggggccaggctttgcaaagaggctgtctagctccaggctccagcacccctttcagccctgatgctatagtgtcataagtttttttctttctttttttttttccttttttctttttttcttttcttttcttttctttcttttttttttttttttgttataatgtgaagtcataaaaattgcaaagttctttgtttgttttttgagatagagtctcactctgttacccaggctgtagtgcaatggcacaatctcagctcagctcactgcaacctcaacctcccaggctcaagcaatcctcctgcttcagcctcttgagtagtagtagggaccacaggtgcatgccaccatgcctggctaatttttaaaattgtgcatatatatgtttccctgtgttgcccaggctggtctccagctctgggctcaagcagtcctgtaaccgcagcctctcaaagtactgggataacaggcatgagccaccatgcctggctcatcgtgattctttacaacaaatctcactgatcacatttcttttgctctgtggctggagagatgcctcagaacccaagtcatgtgcctctaacatcctctctatgtctgattttaattttaaatttattaatggctttaattttgagtttattcatgttttcttatatgtgaggtttataataaatcatacatacatatatttactgtggggagatatgcataacctaacgtttcccactatgaccatttcaagtgtccagttcagtagcattgagcacgttgttctacaatcatcacaccattcatctccagaacgctcttcgacttgcgaaactgagactccgtccccattcagcactcactccgcatccagtgcccctgatgcctcatccagggctgctgcaagccgacccaccaggcaggtgcatggggctcgcatctgggacttcgcacttctaacctctgctctcgcctccccatccctcttgcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcaggtaggccctcccagggaggtctgtcttcttctggaggactagagggagaaatggggtcgagggggacccagggaggtctgtcttctcctgaagggtgggagggagaaatggggtcgagggggacccagggaggtctgtcttctcctgaaggatgggagggagaaatggggtcgagggggaccctgggaggtctgtcttctcctgaaggacgggagagagaaatgaagtcaagcgggacgaaagggacacacatctgctgctgtaggtgtctccagcttagttgaggttctgcccagggaacatgtgggtggggagagcagtgccagtctccgggtgcctccccagtgccacccatcctcctgggctgctccctgcttccctctggcaggaccccaggccccagagcctcccccagcaccaccagcaaggccccttatgggctttgtgtccacgctgtgcaccggcaattcctaatgtgtttcctcatagttttaaaaatcagagacacatggaagtgtcagaggtgtgagcatgagccacgtggtgtcccctccgcaacaaaatcattcgcaaggaaagcagagccccgatcccctgtgttagctgacgcatccttgccgaggagcatgtgtgattttggaggggcaagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggagtggcagagaaggccagggcagggcttcctccccgagagcacccgtgttagatgacagacatgtctgcagtcagcagtcatggcaggggttatgacacacagggtgggggctgtgacctcgcctgggaatcaggaaggtgcccaaagcctaccacaggggaagggaaacctgcaggaggcagaaggtggcggagaaaaagtcctggtcactgaagagccgtgggtgggggagctggagagggagggccggcaaagctggtccctggttgtggccccccagccccccatgtgcctgtgagggactcaaccctggccgcaccttagggttgcttgagaaagttaaacacacaccctcgctggcccctcaccccagacagtgacttccgtggctccaggcgtgactttctttaccccgcgatgattctatcgtgcagaccggctgcaagccagggcgctggggggttcagagagggatgggctgtgtttgaggagaggggatctcagcagcatgaagggcagggaggcctcggcgttggggcagcagagcctcagccagaagccccaggtagggccagctctgttggtcctcttcctgggattaggaagaagctgttcctctcctctgcgttagagctgcttgagctactgactgcacttgttgaaattgaacttaaccttcgtcctttatgtgctatgagtttggaggaacgaccctgtgctcgtctgtgggtgagcgtgggccctaagcctggtaccctggcctgggaacatccttgaattccggggttgctctgtgagaggggctgtgaggaagggacccagaggaccacctgattttattttttttgagatggagtctcactctgttgcccaggctggagtgcagtggcgtgatcttagctcactgcaacctccgtctcccgggttcaagggattctcctgcctcagctcgcaagcagctgagattacaagcatgtgccaccacgcccggctaatttttgtatttttagtagatacagggtttcaccctgttggccaggctggtctcgaactcctgacctcaagtgatccgcctgccttggcctcccaaagtgctgggattataggagtgagtcacggcgcccagctgaccacttgattttttaatgagtaagatttagaaaaagcacagatttctcatttccctaattttaattatgaatattttaaatgtaccccaaagtatagagaatgaggaaccctcagcacccctcatcctaattcagagatccaagatttactgcctgagttttatctgtggaaaattggtacagagcaattacacatgcacagaaagccggttcctcatgcggaacgtgcactttgaccccacttcccagggcctgtggttcaggcctctctgaaactccatcagacgcagagctggccttgccatgagctggaccgcactgagctcatcagtccttcagggaagccagcaaccatcacctgctggcgtcaggaccgggccaggcccgcagccagggtgtcctgccccgtatgagagtcctccaggacagcccggccttcctttcctaccaggtgctggggtcaggcccactccgggccagttgcccggtggtgtaagtgtggcatgcgtcagacttgccgcatggagtaccaaatgcgcagcccacaaacctacttctgtcttttggatttaaagcaccgtcacctcctaaggagccctgtgaacctgcattagccaaagccgattccctgttcttcttcccggtgtgcacacatcccctattcgtgagatataggatagaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctgttctgagcgagcagaacgagacagaaggaagaagagcgtccttcaaagccgcctttacatgcatttttttctattgatttctcaaaaacacatctaaagacagggccagtcgttcagcttggttttgctagaggcagaaaataaataaaacacagccccaggctttaggggtctgtggcctgtggaggggccaacaggtagagaagcaaatacacacagtgcgtgtttgcggcgggggcttccatagacgtgcagacggcaggtcctggggtgcttcgtgggctcagggttcaccccgtggctgttgggaaccactgaggattttaggggggacaactgatttctatcggaggaagacctctcttgggtgatgtaaaggatggatctgagcaagacaggaggaggcgtaacaggtggaatgtgagtgctgtgcgcaggcaggaggtggtgacggagaaggcaggggacctggagctgttttggggggtgtcccagcaccaggagagagaaggacgtctaggcgctttgttccatcctcactttaacccacacaacgtttttgtttgctgccttgcttgttttgtggagacagggtcttgttctgtcacccaggctggagtgcagtgctgtgatcgtggctcactacagcctcgacctcctgggctcaagtgatcctcccgcctcagcctcctgagtagctgggactacaggtgtgccaccataccttgttttgtagagaaaggggtcttgctatgttgcccaggctggtcttgaactcctgggcttaagccatcctcccacctcagccttccacagtgctgggacttcaggcacacgcctctgtgcctggctgtttttttgttttgttttgttttgtttgttttttgtttttttagagatgggatctcactacattgcactggatcaggcagtgtttttaaacagatgaaattaagagaaagcaagcaggaagggcggttttgatgggcaaggtcagggcaaggacaaagatactgaagtctccagggcagggggcagcttggaggacagaggagccctgagcctgatcccacagaaaaggtggcaaatgggggctgttgaattcccaaagcctgctgaggaccatgggagcctcctgagcttgtcccatgggaaaagtccacccgcccggctggacattggtttcatctcacctgtaactgggagttatctaccccagccttccctgccaaccacctgactcgcgggaggtgactgcagctggagcgtctgccccatgtcattgtgtgtccgtgtcttttccacagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggtgcaggtccagccccttcctcgcgtgtcccacgatgccactcagccaaaacatagcgttcgttctctcgtggatctgccgggcccgtgtctgcttttccatttcatttgcttgtaggtgctgagagaaatgcaataggttttctttctgggggcagccaggcacagtgcagcaaacgctctatgcctcgggacccagatgctgaccctgcctgccctcagattaactatgtgtcttggataagggcgtatgagtcatccagcctcagagatccccactctgtacctttgttcaaatgcaattgctttttttttttttacagtctcactctgtcacccaggttggagtgcactggcacaatctcggctcacagcaacctctgtctcctgcattcaagtgattctcctgcctcagcctcctgagtagctgggattacaggcgcctgccactacgcccggctaatttttgtatttttagtagaggcggggtttcaccatgttggccaggctggtctcgaaatcctgacctcaggtgatctgcccgcctcagcctcccaaagtgttgggattacagacgtgagccacggtgcccaacctaatcacattttttaatagtattagaaagtgaggtgtgtctgggaatggtggcttatgcctgtaatcctagtgattttggaggctaaggctgaggatcacctgagcctaggagatccaggttgcagtaagccatgatcacaccactgtactccagcctggacaacaaagcgagatcctgtctcttttttttttttaatttgagatggagtttcactcttgttgccatggtgcagtctaggcttactgcaacctccacctcctgggttcaagcaattcgcctgcctcagcctccccagtagctaggattacaggcatgcatctccacgcccggctaattttgtatttttaatatggatggggtttctccatgttggtcaggctggtctcgaacacctcacctcaggtgatccacctgcctcagcctcccaaagtactgggattacaggtgtgagccaccgcgccctgccgagatcctgtctcttacaaaaaaaaaaagtatagagcattaaacaggtggcatattgtactatgcaatattataaacacagtgacctggggcactgctcagacgttgatgttttgctgtggctcagagactgtcacagaagcatctccatggcatagctcttctcacccactgcagcttgaaccttgcctgtgtccgtggtctagctctgagccgtctgagggccaggtcactactgtgtttccagcagaaactccacaccaggcatagagcaagcattcagtcaataagcatttattgccgaatgacccactatcattagagaaaggagcaaatgaacgtagggtaaagccagccacagagagcacagaccttgtgactccatttacatgaaggccaggaacacccacagtgaatggaagtttccagaaggcagaatcctgcttgcctgttggtggagaggtataaacagggaagatgcatgagagcacctcacaggtgctaaatgtgctctgtctctctacgtggacggtagttacattcacaatcataaagcatcattctggacacttaagattagcatagcttgtgcatttgattatcgtcaattttaaaaacctcataattatcaatgagaccacttctctggataaccagaatgtaactgactgctagaccgcagcctgttttttgttttttaaatagacgggtttcaccatgttggccaggctggtctcgaactccagggctacggtgatcctcccacctcagcctcccaaagtgctgggattacaggagtgagccacgcacggcgcccggcctatggcctgttttgatcctacggagcatccaccagagctgtagctgagcccaggaatgtggtcacttctgtgatatcaccacaaccgctgggccagacctcttcctgagctcagctcatttgttggaggttttcccatcaactgggtcttctctttttggaaaggcagatccctgatgagctgttcttaaaaagaggagctggctacattagccccctgagccaaggagccaggcagagtaggttcctgaccccgaccacaagtcctaccatccttgtgccaaaggggttaaaaaaaccagtcacctaaaatgcctccttatttgcttctataatgttaagcaattcatccttcaaagaaaggatttatttttttctgtataaattcacttctaacaagtgttcgtaaatcagattttattcctgagggatttacagtgtatgaatggcgtgtcattttcctgagttaatgctattacagaatcctgtgtctggtgcatagaaaaatctccctgcttttcactgtcctcctccatctggaaaacagacttgaaaaggcagatcggacctgcagcttccgatgctcagccgcaccctggagtgttaatttaacatcataattgaagccgggaaaaaataacacttatctaccagaatgtctcccgtcctgcccaggagacattgcagaacttaaacctctgttgtgatggcctcactcgacacccctccctgcgtgcactccttatcctcccatcctcgtctgaattcctttctgatcttggtttccacctgctcacctcccatcatcccaaatcccctctcccaggcaagcccatctttcattttctgctctgtgttcttccgttaaacacagagcattaaggtttaaagcacgtcaaaggggggccaggtcccagcagagaggagcctcttggggtttagaaatgccaacgcacttagcaaatacctgccaagcccctggtatgtgtgtaggcgctgtcctgggggctggcgggacactggggagtgtgatggacttaagtctgtacctcaaagagcaaatatgtacatgggcctgagaaacagaggtcactttatgtggtcagggaggtcgcctctggtctcagggcgtttgagctgtgatctgcaggaaggggagagaaacccgggaaatactgggagaaggagcttccagcaagagggagagccccagggggagaaacccgtgttagggaggggctgagggctggaagatgacgcgggggtttgcagggtggacagaccaggccaagcttgggggcagtttggaggccttggtctttcctgcagaatgagccgggaaaacccagtgcaattattttttatgttgttcggtttttcagaactttatttttattcatttgatctgttaatatattttagaatgtgttttgctatgtatttgtaaatttactcttttttgaagtgtgcggttcagtggtgaacgcacaggtacgtgcagtcatgaccacagtcagttctagaacgttcgtgtcacctcaaaaggaagctctgtaccctttctttagccgtcacactcccacacatttatctttacttcctgttttgttaaatgagtgtgagtttttattttgaaatttattaaatatttaatttcccggaatttttagaagtgtatgcattcttggccaggtgcagtggctcacgcttgccatcccagcactttgagaggccgaggtggaaggatcacttgagcccaggaactcgaaaccagcctgggcaacgtagcgagaccccatctctaccaaaacaaacaaacaaaaaatcaaaaaaagtttatgcattctgagtctattttcataaaacactggcaagaatactggtattttgggatcagacagaacaaatatgaaaatgctaatattgtcactttgctccaacactgtgatcagtacctagctcttctccccagctcagccctaagcacagctgaagcaggtatcctcagctctgggctctgcgtgcagcaggactcaggagctgccccgctggccagctctggcttggcgtggctgcggtggccacaccagtaacacgtctgttctcactctcctgctgggctttaggaaaggggatctccaccatggaggagtctgtgaccctggacaacggaggatttgctgccctggagctcagcagccgccacctcaatgtcaagagcaccttctccaagaagaacgggaccaggtaggcaggcagtgctgtgctgcgcccacctggggatctgagctgccagggctggggtggcagcccacgcccactggcacctcctgcatcccgccctgtggttccaggaagcaaaacccaacccaccgccaagtgcgctcccaaaccaccaggggcagccctgagtctaggagggacggggtcggcagagcggctggaaatattttcaggacatctccggagatttagaaagagggtctcaggtgtgtgggaagggcctggaacacccaggggctgccaggctggccttctgtgtcaatcgcatgcaccttggatctgggcgttcctagttcatggaggtgtcacctgggctgccacaggcccgaccaggtgtcctcgcaagcaagcctggtgcttgttgctgatttcattgctctgtgtattccaaagttttcctgtgccgatacacattgccattccatacacggattgagtgcaggcgagaaggattttcatcaccatagcctccttagcttataatccttttcctaaatccagcaggaagcagggtttcccaaacaagagaggggttgacctgggtttgcctttttgatgtgcagagcgccatcctctgatttgagtacccttgaccaaggagaagggccaggaatggggaggggtcttgagcgtctggaaggaaaaacccaaacacctgaggacgcttcgtctggagaacagacagctccgggctttcccagggtgccccagcatcggggtggaggaggcttctctccctcagccagactcaccttggattagactcagctgcaagggtgtggaaatcacacatcatccagacccagacagaccccagggtttcctcttccctttactgtttacaaagctgcaggggccagcagtgtttggagattccctgggccgcccccgccctccactgaatttgggaatcttagatcactcgggtggcgccgaggcacgggtgggccttctcccagccactgacgctctgccagccccacaggtgccagtccaaagcaccgcaggccgccaccccacgaggccttcccaagggctggaggtggatgctggtggtgacatctggtcacacctttcatttcatttgtctactgggaggcaagtttttcctgccgtgtaatagaaacatgaaaaagcaaccacatgtagtttcaaggccaggaggaacttgtcacagagaattttaagatattacatgccctgcttccttgctgcaactctgtcttctgagttctgagaagagacacagccttgaagcacattgcccaagaatagacagtcgttcagtttgttaagtccatctgcttcctaggaaagagaaacatcatttgatggtgaggttggaggttctcagcccacaaagacccaaggacaaaataaaattaagatggaaaagaaaatggacccttcccttaggtttttaaataagccatcaccttttcagtcctagcaataggaccctgtattcatctgtcctcacgctgctaataaagacatacccaagactgggtagtttatacaggaaagaggtttaatggactcacagttccacatggctggggagacctcacaatcatggcggaaggcaaggaggagcaaagtcacgtcttacgtggtggcaggcaaagagagagtttgtgtagggaaactcccctttataaaaccatcagatcgtgtgagacttattcactctcacgagaacagcacgggaaagacctgcccccatgattcaagtacctcccaccaggtccctcccacgtcacatgggaatgatgggagccacaactcaagatgagatttgggtggggacacagccaaaccatatcagaccccacatgtgattgaaggaaaggattctctgctgagaggggaagggtctgggcagggacacctgagattggtcctgtagcatcatccccaaaatatcttagaaatacgggcacagttgatttatgtctcccccgtgcacgtttgtgcttccaatttctttttggggaagacaccattttagctccttagataaaaagatttacccaaatgtttagataagaaatggcatctttcccaaagtaaattacctttgagatagagaaagaaaggcccttgagccttcactgggcctttccaggagaaactgaggcacaccctgggggagacaacacccacgacacaaaaccagaggtctccatcccctccagccttcccagcagagtctccacccaaggcctggtttcctggcctgtagcctctccttgatcacccagtgttacttctcccattgagggatgagaagacacttcctctgtagctgccactcagttctgcactcactcctcgcagcatgagggagggcttgctgggttgctgggggtcctggacatggtccctttgagcacacagctgcctgtctgactgcccacaggctgctctcactatcgagtccctgcacacccttcggaggactaaggagcactcagtcctgcctgatgtgaaaattcagcaatgttgtactcagagtttttccccaagttctgagttctccatctgaaaaacagaagctgggcttttactcagctcagatagtcaccaggaagtggggagctgaagagggtactcattttctatcgctgcatggcaaatgatcacaagttcagcagcttaaaccaacacccatttagcaccacgcggtctccctggggcaggagtctgggcacagctcagctgggtcctctgctcagggccttgcatgggtgtaatccaggtgtagatgggctgtgttctcatctggaggctcaactgggcaagaatcttcttccaagctcattcagcctgctggcagcatgcatttccttgtggccgcatgactgagggccccagcctcttcttggccctcctctggaggccgccctcatgtcctggaggccgctcatggtcccctgccatggggtcctctccaggggctgttcacaacatactgttggcttctgtgaggccagcaagagcatctctgtctccagtccgccaagatagggtctcctaatgtcatgtgatcatgggcgtgatgggagtagctgtccttcacccattccatttaatgtaaccgagtcttcagtctgccatgttccactggttagaagcacgtcacaggcccttcccacattcaaaggatgggatgatgggggtgggggcagtgatggagccatcttagaattccaccagccagagaggacgaatgctcccccaccagacagggagaccaggcctggtgcaaacttccccaattccctctcatctgtaggagacaattcccactccttagcatggcagatcagactgttcctcatgactccatcctcatctctctccactgcactcccctgcctgcatctggcaagcacctaagctccccggcctcctatctgtcccgacctcagggtgctgtttgtacgtgagtgtctcactgcccctcctggcacagaccagctcttcctccatgcctgcaggcctagcacagtctccacaactgacaggcacaggtacacagaggctgttgactcaccaggtagccagtgctcagaattttttgcatcagttgccaaagtgatgtcaaaggctgtgggtttcctcttagtccaacgcaataaaggccaaatgccaggttaggagtcctccggggaagggcgtcttttgcccagagggtaattgcagcatgggtcctcatcctaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcagtgagacttctgccccctcaggctgtcttgtcctatttgagtctcataacatccccacaggcagagccaaggacaaagggcttcattatgcagatgagaaaagagccgaaattcaaccccacggcctgctctgggccccgcagagctcacatagcctcgagcagtctagacattccaaggctgattcatggaggagcaggttgtgactcctaagtcctgggatctgctttaggcccagcagagctcacacagcttcgagcagtctagatgctccaaggctgattgatggaagcgcaggttccgactcctaagtcccagagactgcagtgagagataggcaaggctggtgccctctgtgagaggtttcttgcagagcagagtgtgggtgttgcctgggtgccagcaggctgagtgtcagatggtcgctttcacgtgctccatctcatgtagtcccggggtaactgggcctagaccacctcttacagatggagccggcagggctcagggaagatcagtaactttcccagtgtggactcctgcctcggaggcccattctctctccatttcactttcatagataaacataggctgccataaaaattggtggtctgtagaccccagttagggtggcagcgggtctgatcctgcagggcggatagaaaatgtgacccctttaccagataggagcttcctgctcacccctggacattcgtttccccctacaccctgccagcctcccaccctgcccaggaagcttctgtcctagctccctcccttgcgctgaagaagagggatttgctcacagcagttccaggtcatgtatcgggctcagggtgaatccagacttgggatgtgttcctctcctcaccaagcagctggaccagggagatggcttccccgagggagtgtcagcctccacgcgctccctccaggaccccagggcctacccgcctcaggcctcccctgcgcctgggtgtgcagcagttgagacatggagtgtttttcctgtgccaggtcctgtgcggcgtgacccaaagggactttaaccagcaaggcagccacgagggggctctaagcagggggctcaacacaccttccctacaggtgcaccatctccgtttctcatacttaccagcaaaagcagcagaagcagcaattggagaggttgccccttgggtcctgaacttttttcttttggatatgccaggcctggagaggggtgaaaatcaccaaccattggctgtacacataggcctgccccgcctcctggcactcaggttctaaatcaatatttaatctaaaataagtctcaccttcattttaacctgaattcaggccttattgagccccggggctctatcgaatggcttcttttcaactgtgggttgtagatgaactcccggcgggaagggccagcaggtgggtgtggtgaggccgattctgctttgctttgcgtgttctgtttacagaggatgccgggtttgctgtccgcaccatagccttgggcttggcagaaacagcaggcagcaaagcagatgctcggaaagggacatttgtctaaaactcaggggctgtcaagtgaaatcctgcaaaactacctgcctttttgtgataaagaaaaagcttatcagaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccagggtgaacgtgcactcctctgctgcccaccccagccccatgaggtggggccagtctccttattggtcagaggctgaggttgtccagcaggcggctgttgaagctgacacccagccagacccccgtgtctccagagctcagtgtaccccttccctccccattggtctcctccagccccacaccagaggaaggggagggaggcatccagggatggtgtgtcctagagcaggcgggcaggattggatctgtgaactctgaatatttgttcctaaaagcattttcaacatgggctaatggaacgcatttggtctgtttctccccccaacatatgtggcgtgtttggagatttaacatcggcaaatgtttatggaagattattgagcacacccgtgaactgagctaagcatatacattcacgtatgcatgcacacatgaacacatatgtacatgtacacacatgtgcacggacacatacacacctgaatacatgcacacacctgcatacacacatgcatacctaaatagaacacacaacacacacacctaaatacacacacacgcacacatatctatacatacacacatgcacacacatatacatatacacctgaatacatgcacacacacgtttacctaaatacaacatacacctaaatacacatatgcacacatatgtacacatacacacatgcacacacgtatacctatacacctgaatacatgcacacatgcatacacacgtgcttacctaaatacacacaacatatacacacctaaatacacatatgcacacatacgtacacatacacacatgcaaacacatacatatacctatacacctgaatacatgcacacacatgcatacttaaatacacacaaacatgcacatacctaaatacacacacatgtacacatacctgtgcacatgtacaaataactacacacctgaatacatgcacacacatacatgcacacatgtacacacacgcacacgcacatacccaaatatgtacatgcaaaaatttgcatgtgcacacatacatcatatactcatacatatacctacatacctaaacacatgcacacaggcacatggctcacacatactacatgcatgtacgcatgcatatatacacgtgcatgcatacctaaatacaagtacaagcacacatgcataccaccatgcacacatacacatatgtacatacatgcacaacacatacatacctaaatacacacatacacatatgtacatacatgcacaacacatacatacctaaatacacacatgcacacatgcctgcacatatgcatatacacctaaatacaaacacatacacagaggtggcctcagggagggaggtgagtgtggggagggagggaggtgagtgtggggataggggaagaagggtggagggcaggacatggaacccacactaaatggaattctgcacagagggtgttatcatccttatgtaacaggcagaaagccgagactgagagtttttgaatgtcttccctgagacacgcactgatgagctggactggagaggcagacctcagcatctaactggaaatcccaccttcccaccagtcctgctctcagagctgagtctcaggcagcgtggctgaggtggcaaggggcctgggaaccaggccacactgctcccacatggcaagccctgtgctggaggaaagcgttcctgcaaatgcacctcatggttcctagtgccttttgggtgacaggctgcttctggaggctgatgaaaggtgcagacatgctctccacctacatacaggcagaatttcacctaggatttgggggcccaaggcaccccggaagtctcttacagaccccaccagctagcatcccatagagtcccagctaagaatccccacacctggaccatcctgtgctccccaggtttttgagtggataaagcgtagcctcccttgtctgtagagctctttgctaggtaaccttgctgcatcctgcttttgaagcttatgaatttgggggatttgaaggcactccatattcatgggatcccaacagagggaaccggggacttagatcgttttggaagtgccagctcacatggtaacattcactttgaaccactgtttgaaacagctggattaagacctaactcacatgtcatacaattcactcatttgaagtacacaattcagtgggtttcagtacattcacagagttgtgcagccatcaccacagtcaattttagaacatttccatcagcccccaaaacaccctgtaccgattagcagtcactcctcaatctccccaaaccacccacatacacctgcagccaaccccagctcttggcaaccagtaagctactttctacctctctaggtgtgcctatgtggacatttcatctaaataaatcgtacagtatgatgtcttttgtgactggcttctttcccttagcatgatgattgcaacgcatttgaaccacttttacgaagtaatcaatttgtgtgtttcatcagttctctttcacattgtttgttttaaaatctgacttcagaacttctccctttataggaaacaaacatgttgtattttgcccatgtggtttcttggaacagaagtgtaatttttttttttttagatggagttttgctctgtcgctcaggctggagtgcagtggcatgatctcagctccctctaacctccgcctcctgggttcaagcaattctcatgcctcggcttcccaagtagctgggattacaggcacctgacactatgcccagctgatttttggtatttttattagagacagggttttgccatattggccaggctggtctcgaactcctgacctcaagtgatccgcccacctcggcctcccaaaatgctgggattacaggcatgagccactgtgcccggccaggaagtgtatttttctgtgtagggtctaacggaacacaggccaaatgtcacaaggggatttggaaaggctgccatcttgacaattatgtccctcctagtccccaaccccactctagtcagaatcttctttttaaaaaatgctttattgagttataattcatatatcatataatttgcccatttagaatatacgattcaatggtttttagtattttcagtttttgcaatcatccccacaattttggaactttttcatcgctctaaaaagaaaccccataactctaccagtcacctcccattcccttctccctccaaaccctggcagccactttctgtctctatagatttgcctatcctgagcatttcatataacagactcatgcaatatgtggttttgtgattggcttatttcattcagcataatgttttcagagttcatcagggtcactgatatatgttgtagcacatatcagtacttcatttctatattatatggggggaaattccattgtatggatataccacatttaaaaatgcattcatcagttgatgaacatttgagtttgttgtgtctgggatccccaagagcactcccaagttcagtgattcactagaaggactcacagaattcagcacacaacatcctcatgactaagatttattacagcaaaagaatacagagcaaaatcacaaagggaaaatgtgcacagagcaaagtccagaggagaccagattcacgcttctaagagtcttctcctatagaggcacacagaacacacttagtcctccaccagagagctgtgaggacacataggaattgttgtctaccacggctttaccatagccttgcacttatagcaaactgcaactgcattgtaggtactgctgattagaaactcactgcccagggtttttatcggaagctggtcacataggcatcctctgccaagcatgtaccaaaactccagactccagaaagaaagcaggtgtttggcataaaccatattatttgtacagtttagacactgcagtcttataatttagggaaaacattttatcaatgaaaggaactttttaccagtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggtgagtgtttttattatcgaaaggtttggagttttgtcagatggtttctctgtgtctgtctggatgttttttgtcctttgttctatttatatggtacattacattaactaatgtttggatgttaaaccaaccttgcattcctgcaataaatgcccattgttcatagtgtataatcctttctcttttttttattatacgttaagttttagggtacatgtgcacaacgtgcaggtttgttacatatatatacatgtgccatgttggtgtgctgcacccattaacttgtcatttaacattaggtatatctcctaatgctatccctcccacctccccccaccccacaacaggccccagtgtgtgatgttccccttcctgtgtccatgtgtgctcattgttcaattcccacctatgagtgagaacatgcggtgtttggttttttgtccttgcgatagtttgctgagaatgatggtttccagcttcatccatgaccctacaaaggacatgaattcatcattttttatggctgcatagtattccatggtgtatatgtgccacattttcttaatccagtctatcattgttggacatttgggttggttccaagtctttgctattgtaaatagtgccgcaataaacatacgtgtgtataatcctttctatatgttgctggattcagttttcaatattgctgagcatttttgtatctatacttataagggatataggtctgtagtttacttgtcttatttatctttgtgtgatttttatgtagggtaatattggccttattgaatgatttgggaagtatttcttccacaactggtattaattctttaaatgtttgatagatttcatcagtgaagtcctctggtctcgggcttttgtgtgtgggaaattgttaattactagttctatctgtttattggctatagatttattccgtttccccccccctctttttttttttgttaagtcagtgtcactcatttgtgtctttctaaggatttttaatgctacctcattaatctaatttattaagatacagttgcttatagttgtgtacagttgtttataatccttcatttctgtaaaggcagtggtaattaatatcaataattcattcctgattttaataatttgagtcctctctcctatttctggttaaagttttgtcaattttgttcatctttgcaaagaaccaacttgtagtttgattgattttctctattatttttctactttctatttcatttatttctactctaatctttatgactttcttctgcttaatttggagttaatttgctcgtcttctttcaatttcctaagttggaagtttatgttgttgatttgagatctttctttttttgtaaatacaggactttatggctaaaaattcccctctaagcactgtgttagctgaatctcataagttttaatatgttgtgtttttgttttcactcatctcaaaatatttttttaattttctgtgtaatttcttctttgacacattcgttatttaggagtgtgttttacatttcctcatatttgtgaatttcccacattttcttctgttatttatttctaattatatcctattttggtcagagaaaccataatttatatattttcagtcctttaaaattcattgggtcttattttaaggcctggcctatggtctatactggagaatgtttcctatccacttgagaagaatgtgttattctgctgttttggggtggagtgttctgtatgtgtctgtaggtctagctgatttatcatgttgtttccatcttctgtatgtatgatcttcttcccagttctgccatttgtcagtgcattgaaatctctatttgtattgaattgtctgtgtctcccttcaaatctattcatttaatttcatgtattttgaggctctgttaggtgcatgtgtgtttatagttatatcttcttgatatatttaccattttatcagatatttgctttctaataaagatatgtctcgtatctttattccctattttccactatcagcttctttttgttaaatgaattttccaaatatatcattttgatttccttgtttttgcttttgctctatatttttggatatttttgttagtgtcttactctagtattattatctacctcagatttatagtacattttcataacttatgggaactttactcctatagctgtatttcttccttttctttttgtgctattactatacatattttaccggtagattaatgatttttatcaaatttgggaaactttaagtcattattactttgagtgtttttgtttttgtttttgtttttgtttttttgcttttttctctttctcctctcattctgatattcttattatacgtatgttggtgctgttagtgctgtcttatatttatcaaaggctctgtccatttttaaaagtcttttcttcagactgcgtaatctctatcaatctatctttaagtgaactgattctttcttctgccagctcaagtctactattgagcctatctaatgaattttaaatttcagttattgtatttttcaactcaagaacttcccatttgtgtttttaaaataatttctatcactttattgatattcttcaattgtcatcatacctttaattttttaaacatggtctcctttagttctttgaacataattataatagctacctttgaagtctttgcctgcttagtccaatgtttgggcaccctcagaagctaccttctttttttttttttttcctgtgtatgcattatactttcctgggtttttttgaaaacagatcatttttggtcatatattgcagcaactctgaataatgatattcatgcctcattgagggttattgttgcttgcttgtttgttcagtgatttggctagattcattcagtgaagtccatttcccctgcactgtgtgtgctctcatgttgctcctcagtcttgggcaatgcatagagtcttgctgcctaccagggatgactgtggttttagctgggctccctttgcctgtccccattaagattctggatggtttaccatgattggcgtcatacccagcagttaacctccactacgtgctagctctggttttctcagcaatgccttagtgcatagattgctcctcactttctgatccagttgaagtccagcctttctgcagttgccagatgctgtcagtctttgaagcttgctctgacactaagaggcctcttcttagcttcagaagtctcttttcctggttctgtctttcaaactgctagctggttttaccgcttccattgttgctgacatggaactaccagcttcctcttcattcctcacctccaaagcctccacagttttcaacaatgtccttaggtatgctctgttccaaataaagtcattttcctcagtcagagctggaagctctctgttcttacagaataactctccactctgcgcaggacctctgtgtcactgcatcaaagtggaggtgaggacaatagccttcttcttccatagtgacacacccgctacacaagtggggcactgggttgagagggcagtccctggacttttgggcctgctcctcccagcgtgggacttcttcctacaaacaagctggggtgggagcactcggggcccagtattcttggcgtaccatacctggtacaggctcccagcttacaagcaaaggctggatgcgggacaggagccccagtactcttggccatctctgcctagaatagagcttcttcaacatggagttgggttgggggaaaggggaagctggataagagatgccagaactttcctctccaagttaaattcctaaaccagcagccctgccttgttgccacatctgcccagggtggaatttctgtcacactgagctgggggaattggatagggagagcaggtcatggctcaagcaccacagactctcactatcgagtgagatttagcgcagatcttgtatcaatctatctttctccatttgctatctactctgagcaccatttccaaatactttttttttttttttttttttttgagagggagtcttgctctgtcacccgggctggagtgcagtggtgcgatctcagctcactgcaacctctgccttctcagttcaaacaattctcccacctcagcctcccaagtagctgtgatcacaggtgtgcgccaccacacccagctaatttttgtatttttagtagagacggggtttcgccatgttggccaggctggtctcgaactcctgacctcaagtgatccgcctgcctggtcctgtcagaaggctgggattacaggcgtgagccactgcacccagccttcagagattttagatggttatttataaaatacttttcaccagttaaatcattgttccgctggggagagggtctgctgacctcctcacattgccattccagaaatatcctggccttcatggctagtaactctgatattcagaggggactgggaagaaatgtgggctttggcctggtgccttaactccaagtttacagaaacggaatccagtcccagaactgcagaaaaggctgttagagaagaaagcattgcagggaaagcagaccgagggttgctcagcaatggaataaacccaaaagctgtagcattggttttcaaataggactatcaaaaaagtggcttggatttcgacgagggtttaagacgtttatcctctctactggagacagcttgtagatttgagtacaatataaaccgaaatgttgggaataaagagtaatgtacgtcctcggccctggcttcaagccagtgttttgacacagcatttttgttggtgaaagccgtggacagaggcaggcttctgctcaccgtcttctccagggcccaggggataaggagtgagaagccctttgtggtctctgctagaaaaactctcctgagaagcgaagatttcactaagaaaacagtgaggccatccttttatcccccaggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaagagggtttgtcacggttttatcacatggctgcttctgaatgatatctgccgttcaaatcacatgttaaagattgttttcgaaatccaaagaaactgttttcaaaatccctcctgctcccaccagcttagaccaaccccatcgtacccaattaattccttaataatatttgagtctttcatcttgccaacgtaatacccaaagtgttgagattatctttattagctgctttccaggcgtctgtgcacctttagaaactctcgcagtcggtctgatactgcatccaatcactttctgtccttctacagtttcccgggaaaccgacacacgttgctacttcacatcacacaggaaacttaccaaaaacagactctgcagcatttccattttgtcaataattctaactcactaaaatacatccccattaaaaaataataatgtcatataaataataaacagagcaggcagcaggaggaagaatgacattttaagattgtgctttctcaaagaggcaatgacaggggctgagcaggagccaggaaacccagcttttagcttcagctctgcctgacatttattggtcatgtggctctgggtgtattctcacttctcctccctaaatagcaagaaggaaaagcctcttggagcctcgtgtctctgcttctttctgtacaatggttatgttctgtccgattagctgttattatagaatcacctggctgggtctgtgggcactggccactcagaactcacggcctcccagctttcctccccagaacaaagcactcttcccttccagctgcattgtgaaaaatcccaaggcaagactctgattggctgagctgaagccacatgcccagctattagccaatcacggttttctgagaggcaagctagcctatccatgtggtggggaagaactgcttccttcaaagaaggggttgaggcctagacacaaacaacaggaatcactgcgagttggacgaccaagcactcccaatttgtgtctcccgccaggcccccttcttggcacccacatgtgtcacagacccttctcttgagactacaggacttttagatctttggctgaggaaacatcaggatacatagcaacatatatacaagccgtgaaggaaatggtataaacacgcagatgggtgtgggccatgtgctacactcattctctaagcagttctggacatgctcttggaaatgtggactccagtgagagctcagcagtcccttccgaaccacccctaggccccacccagtgtgaaccctgcttccctacagcctggcagctgcaggaggaggggtgggcaggggtgtacacagggcagagagatgcccaaagggtcaccgagtgggtgcaagacagactaactgaattcgtagcatgccctcccactgaaattgctgatttccccaccatgcagagacgctttccatataagactcacccatataaatagcgtttctctatcttttctacaactggggttgaaggtatctcctccctgctactaaaaggactttatttctgccacctttggctgagaaaccaggctggttttggccccggtctggccccggccagtatgaccctaagaaggtcacttgcatttgtggatgttgattgtttcagacccaagacgaggaaattgaatccagtcaccacttctctcgtttttccccactaggatcccttgtggtagggaagttgaatggggaagacccccgggacctgggaatatagtcaaaagagggtgaaagtcttgaacctcatatttgaccttcagatgataatgaaccctaaccccagtttgtgaaacctagcactaaatttctgtcattcgttcctaaatattctgtgaatttctcgtgagaaaagtgattccttcactatatttcaatacatgtgattttccctaagtttcaggaagtttagattccaagttggtctctaaagaagtaacaaacccaattcaggggctaatcatggagattcctttggcttccttcagatgatctttgttctcttttcttccgttttagtttacgcagagcttaaccttgtaagccacctcaaggcccctagaaaacagatgaagaataaatcttaaacaggccaggtgcaggggctcacacctgtaatctcggcactttgggaggccgaggtgggcaaatcagctgaggtcaggagttcgagaccagcctggccaacacggtgaaaccccatctctactaaaaatacaaaaattagccaggtgtggtggcgggcacctgtaatcccagataggaggctgaggcacgagaatagcttgaacccaggaggcagaggttacagtgagccaagatcgtaccactgcactctagcctgggctacaagagtgaaactctgtctcaaaaataaataaataaatcttaaacagccacaaatacagatccctgatctcttagctgaaacccttgaggctagatatatttaagaatccagtgtttctcaagtttgggagtacatcatatattagggaactgctccagtagggccgggccagcgcttggcgaccaaacacattggtcttcttgtagcagaatatgagaatattcacactgaatagccctacatcagctcacctaggggtaagctgccaggttagctcaagtcagctcagccttcgccaccaaatgagttataaaaaaaccttttgagtttcagagcgttgtgggttttggaatttggaatggagggttgtacacctgttgcgcggatcctagagagaagcctggaactaggaggaagttacaggatctgcggaggtgggtgaacccgaggggttggggagctcaggtgcaggctcccacccagcctctctcgctgagccttgcttctttattcataaagtgggaattgtaacatctgcatcataggatcctcagccagttgcagagatcatgcccgggcattaatctggtatgtaatcggtgttcccgaaaaaggagccactgccacgtttatcatcgtcacccgatgaaggagaagctggctgctctggggtctctgtgtgtgtgggaagatgtgttcatcgtcacctgatggagaagctggctgctccggggtctctgtgtgtgtgggaagatgtgttcatcgtcacctgatggagaagctggctgctccggggcctctgtgtgtgtgggaagatgtgttcatcgtcacctgatggagaagctggctgctccagggcctcggtgtgtgtgggaagatgtgttcatcgtcacctgatggagaagctggctgctccggggcctcggtgtgtgtgggaagatgtgttcatcgtcacctgatggagaagctggctgctccggggcctcggtgtgtgtgggaagttgtgttcatcgtcacctgatggagaagctggctgctccggggtctctgtgtgtgtgggaagatgtgttcatcgtcacctgatggagaagctggctgctccggggtctctgtgtgtgggaagatgtgttcatcgtcacctgatggagaagctggctgctccggggcctctgtgtgtgtgggaagatgtgttcatcgtcacctgatggagaagctggctgctccggggtctctgggtgtgtgggaagatgtgttcatcgtcacctgatagggaagctggctgctccagggtctctgcgtgtgtgggaggatgtgttcatcgtcacctgatggagaagctggctgctccggggtctctgtgtgtgtgggaagatgtgttcatcgtcacctgatggagaagctggctgctccggggtctctgcatgtgtgggaggatgtgttcatcgtcacctgatggagaagctggctgctccggggtctcggtgtgtgtgggaagatgtgtcttacgtctgcaattctcctaaatgcagaggagccacagatggattcagctgttctgtgtattgtaccataagccaaacagtttatacttaatgttcggagaagtcccaaatctgtgactcgctgttagtttcatgtaaatattccagtttgaggtagattttcagcctgtgtccccaaatcccaggaacctctggctccctgctacgcctccatggggtttctgcacagcctggaggctgaccactctcacagggctccgggacagatccaagtccctaggtgccggacggtgtcggctcatggatcagagcttcctgcccgggtgctgatgtgggtaattcactctgactctcagatgagggagcagctggcaggaacatcactcaccgcacccagggacgcttttgttttcctgggtctcagtgtggacctcctgcaaaattaggggagctggcaactctcccatcccctgcccacccccgcctccagctgcaaggacgcagctcacacaccctggggaaaccggattggcagttttccttctagagtgtttacttctgaaagagctgctgtggctggcaatggggcccacatctggggccacagccgtctgtcttaacacccacaaggcgcagctcctagcctggccgctgatgggaatcctcagagagcctgtaaaagaatgcacattccccggcctccgacagacccacagagtcaggatagctggagccactcccaggaatctgctgcctcgatacacagctgatgatcctcagatggcatttcaaggccgctcactcttttaccccctccccagttcccttgataccctctggggagaggaaaaggtcaggtctgcctgacccctgtgagagacgggggccctgggaagcgtcttagcgttagttccgcagcagcgccttggtctctgtgccaccaggtggatcccctaggagcctgggaagctgttaggacgcacaggtgagggtcccaggatgcttccatgcatcgggaggatgtggcacttatcagcaaaaccgagaaacctccaccttcttaggggaaaaaaaaatcaatttcaccctctgctttctcctttttttttttttttttttttttttttttgagatggagtctggctctgtcacccaggctggagtgcagtggcgagatctcggctcactgcaacctcaagaatcccttgaacccgggttcaagggattctcctgcctcagcctcccaagtagctggtattacaggcacccaccaccatgcccagctaatttttgtatttttagcagagacaggtttcaccgtgttggacaggctggtctcgaactcctgacctcaggtgatctgccgacctcaggtgatccgctcgcctcagccacccaaagtccactttctcctttaacggtccttccaatgacttcacatcaaaccgaaagaccataaaatagaggtttgctttcagaaaatgaacctagaaaacatgcagggtccatgttcttaatggaagctgctgatttattttataaaaaggaaaaaaaaaagcctcaaagggactgatcttcaaacatcagtgggaggcctcaggccacttttccgtgtgtttgaggggccaggccattcagtacctggccggggagacatattagacaccctggcttattcaggcagcttcatttctccgtcccctccccaccctcggaggtctctgtggatgtgatgtcacacgatcacttgcaaggggaggatgcaccccccaatcctctcccctcatcacctcccccatcccctcccttctacttaatcacaccccaccccctcccctcccctctacctcatcacctccaccccctctcctcccctcccttctacctcatcaccccctacccctcccctcccctctacctaatcacctccccaccccctcccctcccttctacctcatcacccccaccccctctcctcccctcccctctacctcatcaccccccaccccctcccctcccttctacctcatcacccaccacccccttccctccccgccacctcatcaccccccacacccaccctcccctctacctcatcacctccccacccctcacctccacctcatcaccccccaccccctcccctcccctcccttctacctcatcaccccccaccccttccctcccctccacctcatcacccccacacccaccctccctgctacctcatcacccccccaccccctccttcccctctacctcatcaccttgcccacccgcttccctgtacctggtcacctccagaatccttttgttttggtctgtagcagcccacatcttagtctcaggcaagccaaagacccagatcttccccacccctggggctcttctatgttctgccctgtaggggcaggcagagtcccctggggcctgtgtggggaggctgcgtagacctctgctgggtggggaggccacctagatctttgctggggtgggaaggctgtgtagacctctcctgagtggggaggccgcgtagacctctcttgagtgagggagtccgcgtagatctctcctgagtggggaggccacgtagacctctcctgagtggggaggccgcgtagacgcctcctgagtggggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtgagggaggccgcgtagacctctcctgagtggggaggccgcgtagacctctcctgagtggggaggccgcgtagacgtctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtggggaggccgcgtagacctctcctgagtgagggaggccgcgtagacctctcctgagtggggaggccgcgtagacctctcctgagtgggggaggccgcgtagacctctcctgagtgggggaggccgcgtagacctctcctgagtggggaggccgcgtagacctctcctgagtgagggtggccgcgtagaactctcctgagtgggggaggccgcgtagacctctcctgagtgggggaggccgcgtagacctctcctgagtggggaggccgcgtagacctctcctgagtggggaggccgcgtagacctctcctgagtggggaggccgtgtagacctctcctgagtgagggaggccgcgtagatctctcctgagtgaggaggccgtgtagatctctcctgagtgagggaggccgtgtggacctctcctggggtaaggaaggccgcgtggacctctcctggggtaaggaaggccgcgtggacctctcctgagtgagggaggccgcgtggacctctcctgagtgagggaggccgcgtggacctctcctgagtgagggaggccgcgtggacctctcctgagtgagggaggccgcgtggacctctcctgagtggggaggccgcgtggacctctcctgagtgagggaagccgtgtggacctctcctggggtaaggaaggccgtgtagacctctcctgagtgagggaggctgcgtagatctctcctgagtggggaggcggtgtggacctctcctggggtaaggaaggccgtgtagacctctcctgagtgagggaggccgtgtagacctctcctggggtgaggagaccatgtagattgctcctgagtggggaggctgcatagacctctcctgggtggaggcccagctcttctcggaaacctggtacagagtgaggggctggatgcagctgagaaaatgcagtgtcggtcacacctggatcagggagggggacctgggggctgcctgctctcctgtgtggagggtgggagggcctggcattgggttggggtggggagagggctggagaccgcgacacacgcccctggggaggtgcccccaccgccaggcctcctgcccagcacgctccgggccctgcgccctgccctgcactcacaccttctctcccgctccccgcaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaa

SEQ ID NO: 355 - DNA, 196522 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaa

SEQ ID NO: 356 - DNA, 864315 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagctatcacgcccagcctcataacaaatttttttttaaaggattgtttacatataattatctctttcctcatctctttcgcttttcaagacaaaattgttaactaggtcctcttctagctatttttccagcagtatttaacataacttgacgacttcctccattaacataatgcatgtaaaatacctgttcttatctatacaaaaatatatatgatatatacaaatatgtgtatgtctaggttaaagaataataaagtaaatacccctttacttgaagaaatataaaattatgccaggcatggtggctcacatctgtaatcccagtacccctgcacttcagccaaaataaatataaaattcctagtagctttgatcccccatgtgttcttctttgatcatattttaccttctcttcctctcacatataacccaaacttaatttttgagttatttgtttcctggacttttataatgctattaccatacatgtaatattcctgaataatatcttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatctctactaaaaaaaaaaaaattacccaattagctgggcgtggtgacgcatgcctgtaatcccagctactcgggaggctaaggcaggagaattgcttgaacccgggaggtggaggttgtggtgagctgagattgtgccattgcactccagcctgggcaacaagagcgaaactctgtctccaaaaaaaaaaaaaaaaaaaaaaagaaagaaagaaaaatcaagtgggaagaggaatagtgagtgctttcaccagaggggatattatgcagtttaaaatgggatgatcagggaaggccttattatgaagggaatattaaagcaaagacctgtgaaagaggaagccttattgatatttgagaatgaacattccagtaataacaaatgtaaaggcaccagagttcaagaaacagcaaggaagccagtggggcagtagtgtcatgagatatcatgaatgaatgtggtatgaaagataagaggggtgatgaggtttggagtggttcacaagttgtaaactgtgtagatcatttttaggactttgtcttttattctgagtgagataaacaatatttggccagtttttagaagaattatatgatctgggttatattttaatctggatcactgtggctgctgtgttgaaagcaaaagtaaggaaaagaaatagataggaatgcaattttcaagcaagagatggtaatgacttggactagggtgatagcaagtggaggtgatgaaaagtgattgtgttttggatgtgttttgaaggtcaaataggcagaatttcctgatagattttattatgagacatgaatgaaaaaaaaaagatgatccaaggatggctcttaaacaactagaagagttgagctgtgacattttgagatgactgggattgggagaagactagatttgagatgaagatgaggaatttagttttggataggtttaagatgcctgctgtatatttaagtagagtaacttagtggagagttggatatatggatctagaattcagattagaagtttgcctaggtgcatatatttgatagtcatgatcatattaagactgaaattagtgtagaatagaaaaaagaggttctagagccaagctctgaggcactgtgatgataagaaattggaaagatgaggaagaaatagcaagggaagctgagaataagtgatcaatattgtaggcagaaaaccaagagactggaaggtaagtaccataaaggttttaaagaggagggaatagattatttgtaagaatggatccttggatttgacaatgtggaaattactggtgattttgagcagagcagtgatatgacactgttagaatctttgctggagttgattaaaagcaaatgggaagactggtagaaatgtaaaatagtgcgtctgctgtggaatatagtttggtggttccacaaaaaattaaacgtagaattaccatataatctagctattttatttctaggtatgtactcaaaagaataaaaaactggtattcaaacaaattggtgaacataaatgttcacagtagcactattcagtgatctcccaaaatggaaacaatccatatgttcatcagtggatgaatgaataaacaaattgtggtatatacatacagtggaataatattcagccataaaaaaatgaaattttggccaggtgtggtggctcatgcgtataatcccagcactttgggaggctgaggtgggtggatcacaaggtcaggagtttgagaccagcctggccaacatgttgaaaccctgtctctactaaaaatacaaaaagctgggtgtggtggtgggtacctgtaatcccagctactcgggaggctgaggcaggagactcgcttgaacctgggaggcggaggttgcagtgagctgagatcacgccattgcactccagcctgggcaacaagagcaagactccgtctcaaaaaaaaaaaaaaaaaaaaggaatgaagttctgatgcatgctaaacatgaatgaacctggaaatctctatgctgaatgaaataagccagacacaaaaggacaaatattttatgattccacttagatgatgttctctagagggacagaactaataggctatatgtatgtatgaaagggagtttattaaggagagttgactcacacgatcacaaggtaaagtcccatgataggccgtctgcaagttgaggagcaagtaagccagtgatggatcagtcggagtcccaaaacctcaaaagcagggaagctgacggtgcagctttcagtgtgggccaaaggcctgagagcccctggcaaaccacaggtgtaagtcccaaagtctaaaagctgaagaacttggagtctgatgttcaagggcaggaagcatccagcacaggcgaaagatgaaggccggaagactcagcaagtctagtccttccacattcttctgcctgctttatcctagctgtgctagcagctgattagatggtgcccacccagattgaggatgggtctgcatctcccagttcactgactcaattgttaaactccttcggcagcaccctcatagacacacccaagaacaatactttgcagccttcagtccaatcaagttgacagtcagtattaaccatcacagatgaggtatttagaatatgcaaaatcacagaaacaggagtagaatagacatgctagaggctgtaggatacaggggagttgagttagtgcttaataggttcagagtttctgcctagtatgatgtaaaagctctgcaaaaatatagtggggataattatgtaatattttgtactaaatgccactgaattgtatattgacaagtggttaaaactataaattatattatgtatattttatgcaaaaggacagataaaaatgcaaatggtagttgagtaattgttgaagagtacagaaaactctttcaagacagttttgttataaagagcacagaaatggggaaatagctggttggggttgtggagctaaagacttttttttttttaaagatgcaggtaattacagcatgtttgtttggtgatatgagtgatctaatagagaggaaaaaatcgatataggcaagagggggagaattggctggagtaatattcttgagtggataagagggcttggcacctcttgtagagatggaaagtctgatgatctctaatgggacaataggtcattaattcatgatagcaggaaagaaagcaatgtgatcttgcacccacataagtggtttggtagaaaaggtgatagcggtttttgaaagttctctttggattatttttttctttaaatagttctcttaactcagagtaagcatggggaaggaggagaagctttgaggaaagggaagaaggtataaaattgtcatcttggggaggatgaggagtaatggcctttgaatatgtatgttcactagggacactaaggacctactacacaaaagtgatcatgaatttgaagatataccagtcattgtggttgtatgtatttttctggtcatattctgctgctttagttagggtgatggtgaaaataatctggaggacaagatcaatgcagaagaggtggtcaaaaaactgagaaatcagacttttggaatgatcatctctctggatattgaaatcaccaaggattatgacagtggtagtgtgggactgaatccaaaattaaatcttcagacaactagtagaatgatgtgggattgatttatgagtctaagaaagagggataatgggtcttacagtctgttccatatattttgctatattttgaacaatgctgatgtaaatgttctggtacagatcttctgacatatatatgtggaagagtttctttgggatatgcttctttttctttaaaaatgttatcgctgggcacagtggctcatgcctataatcccagcactttaggaggccaaagcaggcggatcacttgagcccaggaattccagaccagccatgcaaatatggtgaaactctgtctctacagaaaaatacaaaaattagctaagcaggatggcgtgtgcctgtagtaccagatacttagcaggttgaggtgggaggattgcttgagctggaggggtggaggttgaattgagctgagatcatgccactgccactgcagcctgggtgacagagcgagaccttgtctcaaaaaaaagaaaaaaaaaaaagaaagaaaagaaaattatatctgggttaccagggacttttttgtagtcgtttttggtgcttctcctcttctgtatgacctttaaatgttggcatatagggcttggtctttgaccctctcttcttttctatctacaaactcccaaggtgatataactccatcatgatatagatgctgatagactaccaaatttgtgtctccacttttcacttttccctgagctctagaattcaactgccaattttatatttccactttcatatctgattgatacttaacacatacaaacagaactcttgatttttctttgcagttgtgcacccccacccccactattttacctttcattaaattgcaacattatctactaatttgctcaggcttaacatttatcagtatcttttcttctcccaccacatctaatcagtcagcatgttctgtcagctgtacctctaggatgcagtcatttctcatcagctttattgcaacttatagaccagtagttttcaaactttttgatctcaaggctccaggaaacctttgcattcttaaaaattattgagaactctgaggagttttgtttattcagattacatctactcatatttattgtattagaagttaaaacaaatcttaagaatatgtatatattaatttattttaaaatgaatttattatatgttgatgtgaatatcattttataataaaagtaaaattactgtattttaaaaggtaagaagggacatgcattggttttatttttgtaagtatcttgaatgtctggcttagtagaagatagctgaatttttgtgtctgcttcagtattcagtctgttaggacatgttttaattaatgtatatgaagaacatctagcctcacatagatatttatttggaaaggaaggggtattttaatagccttttgaaaaattatggatattccttttgatattacactaaagctcattaagtggtaattttaaaaggtttgttgggctgggcatgatggctcacacctgtaatcccagcactttgggaggctgaggtgggcggatcatgaggtcaggagttcgagaccagcctggccaacatggaaaccccgtctttactaaaaatagagaaattagcctggtgtggtggcaggcgcctgtaatcccagctacttgggaggctgaagcaggagaattgcttgaacctgggaggtggaggttgcagtgagccaatatcgtgccattgcactccagcctgggtgacagagcaagatactgtcccaaaaaaaaaaaaaaaaaaaaaaaaaaaaaaaaaaaaaaaaatttgttgtttcttcagcacttagaaattgcctggtatgttttctacaaatatttattttttgaataagtatgtgcatccatccattatccatacatctgcccaccttttcatctgcttttcagtttacaaaaatttatggactcatttttcaggttttgtttcctctccaatttcattttttgtgggtttattatttcatgtctgcatttttgtaaaggagataaacccatgtgaaatgagctaaacttttgaaatagtggtataggtattattccaggcaacttgttacattgtggggttgcagcagtggaaaaaaaaaaagtttctgttcccatggttttaaatttagcatagattttctttgtattagtactaaagctacacaatttataactacaacagatggcaagttataaaatactttaagatagctggactcagtggctcacgcctgtaatcccagcactttgggaggctgaggcgggcggatcatgaggtcaggagttcaagaccagcctggccaatatggtgaaaccctgtctttactaaaaaaaaaaatttacaaataaatattaaagacttttctacttaagataattcaatgttttctaatatgacaaaagttgaaaaatatagagaataaatttcaactaaagtttgtgtcatagcttgattgatttaattttttaaagtttgggcaaaaattataatgcatatattagctgtactattttaacatcattattctcagttctactgaaaaaaattatttttgtgattgaaattcactgatttagcattgattaaagggataaggattcatcttcaaaattaaaatataataaaataagatattaaaaaatataataaaaaggcaactgttgataaatattgttggatatgttgtcagtttttttaatatcaaaagtcctgacatatagcctgggcaacatagtgagaccctgtctgtacaaaaaataaataaataaattagcagggcatggtggcgcttgcctgtaatcctagcaatttaggaggctgaagtgggagtattgcttgagtcctggagtttgagctgcaatgagccatgttttcaccactgtactctagcctgggtgaccaagcaagactgtgtctccttaaaaaaaaaaaaaaaaaaaaagtctgacattttgtaaaaagaaaaaaaagatatattgtcagttttagattggaataaagcacttatttttgtggaagattgtgagggaagtcaaggattacaagttaagtaccgtcctttctggtgattttttcctgtttagttttaaatttgaaattattctgatatatttctgttaacttgattgttgagaggaattatattcaacggaatcagtcaaaataggcatttatccaacctgggcaacatggtgagaccccatctttataaaaaaaaatagccaggtgtggtagtgtgcacctgtagtcctaactactccggaagctgaagtgggaggattgcttgagccctggaggttttaggctgcagtgacccatgatcgtgctactgcactgcagcctgggtgacagaggaagaccctgtgtcaaaaacacaaacaaaggcaaacaacaacaaaacaaaatagtcatttgtgtataaaatttttatagacttcttgggcagtatttgtcaatagttaatatatctttttataattttagaacatttatgtttcttaaagtttgctcttagggaaataccttgatattaaggaggaaagcattagaattcattgctcagcttagatttgaagaatgtttggaattaatttctggttcatatttttgttaagaaaacaagatcatgtttctacattagcattttgagcagttgatatcagtccagcaaaaatcatgccaaattaaatctagcatttttctaagaatgtttaaaattattcttgtaatgttcgggtcctttttttttttttttttgaggcagagtctcacactgttgcccaggctggagtgcagtggcgcagtctcggctcactgcaagctctgcctcccgggttcacgccattctcctgcctcagcctccccagtagctgggactacaggtgcccgccaccatgcccggctaattttttgtattttttttagtagagacagggtttcaccgtgttagccaggatggtctcgatctcctgacctcgtgatccgcccacctcggcctcccaaagtgctgggattacaggcgtgagccaccgcatgagtccttttaatcaattaattgctttttctctataataattgtagacagctgaagagggatcaatttaaaaaaattcaagtttacttcagtaatcattctagattacagaattgtgctttaaaatagctacattgtatatatcagtactagaaacatccaagaaataggagtctacattacataaaaatataaaatataaaaagctttattataaagaatgagaataattagttgatactcaatatagagaagtcactgtgcttaaaattgtaactttctagttcaagaactttcattaggcctaagttaaatattggtttttttaaaaatgtgagctttgactttgcatttaaaagtgatgaatatatctatgtcgtaagaatgaggggaagtaaataattggcaaacacatgctgaataccttttttaaaaaagtaaccttttctttttggaataattttagagttacagacaggttgcaaagatagtacagagagttcctttatgttctttacccagtttcccttattgttatgttatcacagtatatttgtcaaaactaagaaggcttcattgatgcattactgttacattttgaacattaattgaatttcatgatatgttttttctgtaccgtgattcaaaccaggataccatgttgcatttagaatagtacttttgtaaaataatttatgtaatttttgaaacatataaataatatgttataagcatctggggagttaagaattttttgttttgttaatatctagattagtacaggtgtacctcagagatattgtggacttggttccataccaccacaataaagcgaatatagcaataaagcgagtcacagaaattttttgttttgcctaatgcataaaaaattatgtttgcacaatattgtagtttgttaagtgtccaacagtatgtctaaaaccactatatataccttaattaaaaatactttattgttaaaaaatgctaacaatcatctacactttcagcaagtcataactttttgctggtggagggtcttgactcagtattgatgattgctgtctgatcagggtggtggttgctaaaggttggagtggcagaggcaatttctcaaaataagacagcaatgaagtgtgccacgttaattgactcttcctttcatggaagatttctctgtagcatgggatgctgtttgactgaattttactcagagtaggactattttttttgagacagagcctctctctgtcacccaggctggagtgtagtggtatgattttggctcactgcaacctccgcctcccaggttcaagcaattcttgcacctctgcctcctgagtagctgggactgcaggcatgcaccaccacgcttggctaatttttgtatttttggtagagatggggtttcaccactttggccaggctggtctcaaactcctggcctcaagtgatccacctgacttggcctcccaaagtgctggcattacaggcgtgagccactgtgtccggcttcagagtagaacctctgtcgaaattgaagtcagtccttttcaaacactactgctgctttatcgactaaatatacagaacattctaaattcatcgtcatttcaacaatgttcccagcatcttcaccaggagtagattccatcttcagaaatcactttctttctttatccataagaagccagtcctcttcaggttccacttctaaatctaattctttagtagttacttcctccacctaagtcttgaatacctcaaagtcatccaggagggttaaaatcaacttctttcaagctcttgttaatgtggatagtttgacctctttctatgaatcacaaatgttcttaatggaatctggaatagtaaaccctttcaggaaagtttttgatttactttgcctagatccatcagaggaatcactatctatggtggctatagccttacgaaatgtattccttaaataataagacttgaacatcaacattactcctaatccatgggctgcagaatggatgtcattttagcaggcatgaaaaacaatattcatctccttgtatgtctccatcagaggtgtagggtgaccagatgcattgtcagtgagcagtaatattttaagaggagtccttttttttgagaagtaggtttccataggcttaaagtatttagtaaaccatgccataaacagatgtactgtcattcagtcattttttttccattcatagagcacaagcaaagtagatttagcatgattcttaagggccctaggattttcagaatggtaaatgaacactatcttcaacttaaagttaccagatatgttagcccctaacaagagcatccgcctgtattttgaagctttgaagccaagcactgacttttcctctctagctcagatgacatcttcttccaggagaaggctgtttggtctgtgttgaaaatctgttgattagtgtagccactttcgttaattatcttagctaggtcttctgggtaactgcgtgcagcttctacgtcaacccttgcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttttgcattaatgactgggccaactgtttggctcaagatgcctatgttttggcctgtcttggcttttacatcccttcttcactaagcttaatcatttctagcttttgatttaaagtgagagacagggactcttcctttcacttaaatacttagaccattgtaatattactaattagcctaatttcaatattgttctgtctcaggaaataggcccaaggagaagggagagaggggagtggctagacagtggaacagtcagaacacacacatgtatcaattaagttctcagtcttaaatgggcatgttcatggtgccccaaaatagttccaatagtactatcaaagataactgattacagatcaccataacagataataataatgaaaaattttgaactattgggagaattaccaaaatgtgacacagaaacacaaagtaagcatgtgctattgggaaaatggtgctgatagacttgattcatgtggggttgctacagacttccaatttgtaaaaagtgcaatatctgcgaagtgaaataaagcagagtgcaatacaatgaggttcgcccctacttcttatctagctggctttcaataagtatttgttgcatgattgaatgagtctatgagatttagtaggaaacatcttttgaaaagaaatatgcttgattctatttccttcataggaactagaaagagcctgttttatctttttgcatttcatcaccactttcttttttatttcaaatagtgagaagtcttggaaatgactgaaactacacgttgttgaatgttttgttgaatataaaatgaactgaggttatactatatgtaaatttttggcagaatacataaatgattttgtgagtatgggactgttattgcacacagctttcactttttaaaacaatattaagaaggagtttaaaaagtatttaaattctctatatacgttgagactagcatattcaacctttataccatggataatctgttacagctgtttttgttgcacctgctttcctgcttaatatttaaatttcctgaatcttaaaattggccttgttttaatcaattaatcatcataatgacaatttattgctctttaatactaaatttgatttacttaatattcttatatttcttagctcacagaaatgcaagttgagagtagttattacagtccacagaaagtaaaatctaaagaagtattgtgttgggaacaagaaggaactacagttgaggtaatctttcaatattgaacctgtatttttaaatattttgttctttaatattttataaatacctgtttttatcagatgtagtgtatttaaaaatacaagtaagatgtttgtttcttattttaatagagtttactatctcatggatagtataaataaatagtatagaataaatttaaaaatgacataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttatttatgccctgcttcaaaaataatcgtggaggaaacatgttgaattacctctgttaatttttgttacttttaatgtgtgggattgatgtaaagaaatgaggaatttacctttttactatctatacttcttagtgttttttaaatgtaagaatatattaatatgtttatggaatattaatacatttatgaaatcagttaaaaattcagataattacctgaagattaatgcaataggataatttacattttactctttttttatcaagatttacttccattgttaaaatatttaatgttgacttgcataattaacatacatttagaatatttcagtatatctttagtgtttgaattgtttcatgatatgaagtatttaaggattaattctatttgagagtatacattattagacagttttgtgatagtgataaaggtcaggagtgtactatctcctccattgtaggtatttattaactagacatgattaataaagtggtcaaaatgtctcataaaagtatggatgtcttttttgtgtggtctgtaatagatggaatattacctttcttagaagtaaattcttggaataacctctgttcttttggtcatcctttgtgttgttatacattctatataaagatatgtgtctaacctatcaagctttaaactcaaaagtttcttttatacaatgtttattctgtttgcattgctttgttggcaggagacatacactgagatagctggaatgcaacggtttggggctttttatatggattacctgtatacaatggagaacactagtggcaaaggtattggcttctttcctttatgtgtgccatttcttgaacaactgaaacaaagccttcctcagaatcaattggtccttgactggttgtactctgctacataagatttatcttctagtactttggggagtggtttaattttaacatcatgttagaattgtcttagattcttgtcatttcaaatccattctttatacagctgactgaagacattttgtataacctgttagaattagttctcatgtgtaccatatattatgattctgatatatcaaattttatattacattaaatttttaaaaagaataaaccttttctattctaaatacactttgaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattctaatatatatatattttttgagacagagttttgctctgttgctcagagtgcagcgtcatgatctcggctcactgcaacttctgcctccctggttcaagcgattctcatgcctcagcctcctaagtggctgggactacaggcatgcgctgccatgcctggctaatttttgtatttttagtagagatggggtttggccatgttggccaggctggacttgaactcctaatctcaagtgatccatccaccttggcttcccaaagtgctgggattataggcgtgagccaccgcactcagccaggttctaaagctttcttactggtcttcctgctttcattgtagtcctatagtttctactgcaatcacagggatttaattctctgctgttaattttcatgggcctgacattggtttgtttaaaaacaaaatttaaatagtttactagattctggtcttgagttacttggtggatagtgataactattaagaaagctaaataagaggaaaatttttggaggaaaagatgagttttgagataactgtggacattgaagtgtaaatattccttagccagttatatatatgaaagtgcaactcagaagtcttgtgttctaatagcattgcaaattattgtagtgttgtagttgccacttgtaaactggtaggtttcctcttgttcaatataatgtcttatgcatgtgctgtggattccatgtcttgtgaggaggtgaagtatgtagtagttaccttttaagcaaaggaaacctagcacagaacatctttatttgtatatatgcctctcctgcagtttttaaaagatagaaacatgatttatgtttgttagattgtttatatattacttctgagaagccagtagtttgttaacttttgggtttttcatatttttcacttccatgaatactatacagtgttacagatattatagtccttaacttttaaaacaaaatattgaatattgcacatgtacagaacagcaaataatttaaaactgaacacctgtgtattctccacgcacaccaagaaataggacattgttagcatccagtaagcctcctatgtgtttcttttctaccacactctgcctcctttactggaggagattgctgttttgagattcatgagaaccactgtcttgcttttggtttatccccattttacagatgaggaaacagcaaacccaatacaggtaaagtaacaagaaccaagatcacacacagtatgtgggatttgaacccaacctatccagctctagagcctacatttataactattctgttgatatttcctttttttttttttttttgtttgagaccgagtcttcctctgtcgcccaggctggagtacagtgttgcaatctcgactcactgcaagctccgcctcccgggttcatgccattctcctgcctcagcctccccagtagctgggactacaggcgcccgccaccacgcctggctaactttttgtatttttaatagagacagggtttcaccatgttagccaggatggtctcgatctcctgacctcgtgatccacccgcttcagcctcccaaagtgctgggattacaggtgtgagccactgcgcccggccctctgttgatatttctttctttcttggtttacctgaaacaagaaatttgtagaattttaagtattaatgagctaggaaaagtaatgagttcctataagaggatacttgtaaatacttaaaaaaaaaaagctttatctaaaactcttgtttttttgtgacaactttttttttgtttctatagtctacattatcaaaaagtgccctaaattttattaagtaaatatctaaacacgtattgagccaatatttttacagagtttgtagtgaatcctgatagtttgaaggcggatttgattttgtgtgttttaagtaagttcatggcagtattctaattaatgtaagaaactaggctgagcgtggtggctcatgcctgtaatcccagcactttggaaggctgaggtgggcagaccatgaggtcaggagttcgagaccagcctggccaacatggtgaaaccccttctctactaaaaatacaaaaattagccgggggtggtggcaggcgcctgtaatcccagctacttgggaggctgaggcaggagaatcacttgaaaccggaaggtggaggttgcagtgagctgagatcataccactgcactccagcagcctgggcaataagagtgaagctctgtctcaaaaaaaaaaaaaaaaaaaaaaggaagtaaatacagtaataaaggaagcttctattatttatttttcttgtaataaatgataaaatagtatcttgtccacattatactatggcatataaataaaaattaagtttcctctgctactatttggtattgatgataagctgctgcttctcttcttctcctccttctcctcctttcttcttgctgctgctgctgcttcctccctctcctccccttctcttctcctcctctccttcctcctcctccccctccttgccttcctccccctcctccccgtccttctccccttcctcaccctcctcctcctcctccttctccttctttgtgagtatactttagtcatttttgtttacaactgaaactctggaaaaattaacatcttttgcccaggagcttcttacagacaccagtaaaagtttgaaccttgtgttccacaagataagcatcttctgacaattattttacttttttttatggtacttgaaagcaagtgatgttttaaaaactaaatggaaatatttattattaatataattgtgtaaatatttgttaatgttgtaatgactacctttctagtcttttctgtttaagggggttattacaaatgttatggaccctaaagtagatagctgaaattgtaatgtacaacaggaagattttagagataaccaattttagagatacaataggagataaatctgaaacaattaagttattgaattgaagggcaagaattgagaaagagtcttgactcttaataagggcagccaaacattcagggagctggagtggccagatgcatgaaaggtgggcacaagtaaatagctgaaaatatatagctaaaagccagttgtgtttttacatttcagacaagccatggtatctaaatttaaactgcattatattcagttttcattatggggggcattggcctgtattattttagagacaattttgtgtctaaaagaagagtcttgttatacagtgacatcatttagggagtctattatcccctaaaggacgcatagcagggcatttttattgctttttgagtattttgatttgtaaccgaagttctatctttaagttacctcattctgtcttacatgtaattctagaaatgtaatggttttagctatgaaaagtaatggttttgatgtgaatggtatgttatttatacctaattcctaatgtgagtcagtattaatcatacatcttacaaaatatgtataagattaattttgtatgttttatttgatgtgacattgggcttatagatttttacttgtattatatagttaactttaaaataatctttgcactaagtcgtctggttaaaaatatgtgagtaataaatctaattaatttttggccaggcgtggtggctcactcctgtaatctcagcactttgggaggccgaggtgggcggatcatgagggcaggagattgagaccatcctggctaacatggtgaaaccctgtctctactaaaaaaaaaaaaaaaaaacaaaattagccgggcgtggtggtgggcgcctgtagtaccagctactcgggaggctgaggcaggagaatggcatgaacccaggaggcggagctttcagtgagccgagatcacgccactgcacttgagcctgggtgactgagactctgtctcaaaaataaataaataaaaatcaatcaatcaattaatctaattcatttttgttcatatgatgaagactaaagattgagctgtactcctttgcatgaaataatggaaatatatttttgtataaaagtattagaaggtatagatataaaagttttgtgtaagtaggcttttctagtttctaaggttattaaatcctggaaaattctttcttctttttgtctgaataaacaaaatgcattataaattaaaaatcatttttatcacaataatggattcatgtatacaaaaaacctctcatttaagagatgtacatattagataatgacacatgcctatacctggggccaatatcttatttagaaaacagtgtatgaggagatgaggagtctaggaagtaggattctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactctagagtagagcataatagtgtaatgaggaagtataagataatgaagaactcaccctgtggagtcagactgtggtttaaaatttgaccctcacttcttagtatccttaagaaatttaattaacatctttgatgtttcatttctctgtctctacaatacgtttagttactgtgacagagatggctaattgtctcctcaatatccatcctttttcatagtaatagaaatttctataacagaagtaaagactatacatttaagggatagtcatatgactaggttctgtctactgggatgggagcagaactttatgtgatgttttgggccatgactttaaaaggaaaagagcatgccttccttcttttcttctcttctttcttctggctggaaaataaatacaatggtatgggctggacctgccatttcagatcctgagattaaagctgcatgctgaggatgacagagtagcaagataaaaagcacctaggtcctcagtactgtgatggcaccatgtccgccctggatcctttagactcagattgtttcatgaaaaagaaataaggactgagcatggtcactcatacctgtaatcccagtagttagggaggccaaggcaggaggattgcttgagcccaggagtttgagaccaacttgggcaacatggcaagacccagtctctacaaaagattaaaaaaaaaaaaattagttgggtgtggtggtacatggctgtggtctccgggctgagcagggagaattgcttgagcctgaatggttgaggttgcagtgagctgtgattgtgccactgtgctccagcctggccaacacaacaagaccctgtttcaaaaaaaaaaaaaaaaaagctgctgtttttgttgaaatttctattactttacttttgtcccagcaactttactgttaccttaaatgatacactgataggacctacttccaatgattgttctgagcactaaatgagatagtgcacataaaagcacttaacccagtgtacagtaagtgcttgacacattcatgcattcatttattataccttacttgaatgcctaccctgtgccagacattctttatgtgctaggatagtatagcaaacaagacatacaaagcctttggtctcatggagcttatatcctcatggggtagacaaatagtaaacaagttaaaatatttcagtcattgataaatactagagaagaaaaataaaaggaagtgtgagcaagagtgccagaaacagaaggaggggagagctgttttagtagggactttaggaaagttttctctgaagtttatatgtgagctaacttgtgaatgatgtaacggagtgaatcatgcatgtatttgtgaaaagagggttttatgtagacaagtgcaagagccttgaggtaggaacagtttggcaatatacagggatacaaacaggctagaatagctgaagcacaataaatgtttgtaagtcatagaggtagacatcaatcaccttgttgggttttagggaccatgtagtctggattttattctaaatgtgatgggaaatcatcagtaagttttgaataggaagttattaacttattattttaatagtaaatagtatggttggcatatgttttcattttaaaaaatttagattttcctagttttacttgcactcatttgtgtgcatgtgtattaagttctatacaatttcatcacctttgtaggtttgtgtgttcactaccatggtcaagaaaatgaacagttccaataccacaaggatctggcatgttgctctcttacaaccacacccacttccctaccatgttcctttctcctccctcttttccaggggctagggataacccctggaaacttttgtcttccatttctaaaattttgtcatttcaacagtgttaaataagtgaaatcatacagtatgtaagcttttgaggttgacttattttgctgagcataattctctggagactcattcaagttgttgcatgtatcagtagtttgtttcttttcctgctgagtagtattccattgtatacatatactatagtttgttaattccctcacttatggaagaatatttgggattattctagttttgggctattacaaataatgctgctctgaacagttgtgtactggtttttgtgtaaacatttcttcaggataaattgctgggtcatatggtagttgcatgtttattattttttttaaagaaactaccaagctgttttcaggagtggccataccattttacattaccatccaacgatgactgtgtgatccagcttctttacatcttcccagcattttgttttgtcactgctttttattttagccattctgatagatgtgtagttttaatgagcaatctgccatctcattgtggttttaaagttgtgtttccttattggctaatgatgttgaacatctttttatgtgcttatttgccatttttatttcttcagtgaactgcatatgtcttttgctcagattaattgggttaatctgaaagttttaatgtttttcattttatactcaagtatgtcatcattttgaattaattttttacataaggagtgaggtttagataggggtttatttatgtgtctttgaattttcaattgcactagcaccatcctttctttattgaactggttttttacctttgtaaaaaatcaattgagcatatttgtgtgggtctgtttctgagtcctctagtttgttttcagttagtagacctgtggtatttcccactgtcagtaccatgctgacttaattactgtaactctatggtaaacctttatattggagggagaagttattcattttggttttgagggaacatttgcttaggttagaaataacctcattataactttcatttacatatatctctaatggaatattgggttggctgtttcgttttgtttttgtttggagatggggtctcactttgtcacctaggctgaaatacagtggtgtgatcatggttcactgtagccttgatatcctaaaatcaagtgagtctcctgcctgagcctcctgagttgccaggaccataggtgtgcaccaccaagcccagctaatctttgttttttttgtagagatgaagtcttactatgttgcccaggcttatcttgaactcctgggctcaaacaatcctgccttggcctcccaaagtcctgggattataggcatgaaccactgtgctggcacttgactcttttaatatagatctattggtgttatttatttttctcatggaaaagtccaagttggtcagtattccagggaaactgttttatgaggttgtcttagacccagattccttctattttattgttctgccaaccccagagatatgccatatatacatggtcagaattgggtcaccattatagtgtgtaattttaatcaggaggaagggggaacaagactataaaggaaggtatgtagtcttatttatttatttatttaagatgtagtctcgctttgttgcccaggctggagtacagtggcgtgatctcggctcactgcaacctctgtctcccgggttcaagagattctcctgcttcagcctcccgagtagctgggattacaggcacctgccaccatgcccagctaatttttgcatttttagtacagatggggttttaccatgttggccaggctggtttcgaactcctgacctcagatgatctacctgcctcagcctcccaaagtgctgggattacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctctcaagatgggaaggtgaatgagaaatgctcttttagcagctcctcacaagaccacatatgatcctttgtttttagaggatcacaggatattctaccaaggtctgctgtggttgagtattgccttcatggcatggatttgtgtaacattatcaggatgctggtacagactagacccaccatagtacttagctcctaggattattttaaattttcattgaaataatgcatgtaaactattttgcatgtattaggaactgagtgatgtctgctgtaattgttgagaatgcttaatatttgtttatggtccatatacaatgtattgctttctgagtttgacttatacatacaaggccttatttgttcgtttgtttgctttttgagacagagtctcgctctgttgcctaggctagagagcagtggtgaaatctcagttcactgcaacctatgcctcctgggttcatgcaactttcctgtctcaggcttctgagtagctgggactatgggcgcatgccaccacgcccgactaatttttgtatttttagtagagacaggatttcaccatattggtcaggcaggtcttgaactcctgacctcaggtgatccacctgcctcagccttccaaagtgctgggattacaggtgtgagccaccacacctggcctatgtgtttttttttttttttgatatatttcttttgatgttcatataatgatcaggggtccccaactcctgggatgcggaccagtactggtcagttgccttttaggaactgggttgcagagaaagaggtgaatggcaggtgagtgagcgttaccacctgagctccgcctcctgtgagatcagcgatggcattagattctcataggagcacaaactctattgtgaactgtgcatgcaagggatctaggttggcactccttatgagaatctaatacctaatgacctgaagtggaacaatttcattctgaaaccataccccttctcctgtctgtggaaagattgtcttcaatgaaattaatctccgatgccagaaaggttggtgtccgctgacagtgataatcatagaaataaaaagtgtcctaactttaaagaagttatgtaagggaattaactatatgcattaactttatttttgctccctactggccactcatcattaagtatggtagtgtattacgattaagagatcatgtagagaaaatttcactggagacaattaaaatatgtctgcattttgtcatctctgtttttgctatcatctaatttttaaaatagatactattttttagagcagttttagattcacaaagcagagtgaaaggtacagagatttttcataaactgactccccccacgtacatagcttccctctttgtcaacatccctcaacagagtagtatgtttgttacaattgatgaacctgtattgacacatcagtatcacccaaagtccacagtttacattagggttcactcttggtgttttatgttctatgagtgttgaaaaatatataattatctgctataacaatatcacatagagtagtttcaattcccaaaaaatcctttgtgctctgcctattcatcccttcctctccctaaccactggcaaccactgatctttttactgtcctcacagttttgccttttctagactgtcatatagttggaatcatatagtatgtagccttttcacattggcttcttttacttagtgatatggatttaagtttcctctttggcttttcatggcttgatagctgatttcttctttgcacttactaatattccattacagatgtaccacaatttacttatccattcacctactgaaggacatcttggttgctttcaagttttgagagttgtgagtaaaacaggcatatacatccacgtgcacgttttggtgtgggcatgttttcaactcctttgggtaaataccaaggagtgtgattgatggattgtatgctaaaagtatgtttagttttgtaagaagctgccaaattgtcttccaaagtggctgtatgattttgcatccctgccagcagtgaataagagttcctgtttctccacatccctaccaacatttgatgttgtcagtgcttcggttctttgccattctaagacatgtgtaatggtgtcttattgttttgattttttatttccttgatgacatatggaaacatcatttcatatgcttatttgccatctgtatatcttctttggtgaggtatctcttcagatctattgcccattttttaagagttgtttgttttcttaatattgaattttaaggattccttgtatattttgggtaacagtcctttatcagataggtcttttgcaaatattttcccccaatctgtggcttgtcttttaattttcctgtattttgcagagcagaaattttgaatttttagtgaagtcctgcttatcaattctttgttttatagattgtgccttttgtgttatatctgaaggtcatcattatacccaaggtcatcagcttgtatcctttacgaattggtccatttcatctaggttatcaaatttgtaggtatagagttgtttatagtacttctttgttttttttttgagatggagtttcacttttgttgcccaggctggagtgcaatggcatgatcttggctcacagcaacctccacctcccgggttcaagcgattctccttcctcagcctcctgagtatctgggattacaagcatgtgccaccatgcctggctaattttgtatttttagtagagaaggggtttctccatgtcagtcaggctggtcttggacttctgacctcaggtgatctgcccaccttggcctcccgaagtactgggtttataggcgtgagctaccaccgcacctggccttttttagtattttaaaaattatcattttagtgtccttgggatttgtaacaatgttcctctttcatttctgacattaggaatttgtattctcttacactttttcttagcctggctagagaggcttactgatttttattgagctagcttttggttttgtttattttctctattgattttctgttttcaatttcattgatttctgttttgattttaattcttttcttcttattttggatttatttaatttcctgaagtgtaagcttaggtgattgattttagattttccttttttgtaatatatgaactcaatactataaacttacctctaagcattgctttcactgcatgctacaaatttcgataagttggatttttgttttcatttaattcaaagtattttgtatttctcttgagatttatttctttgacttgtgttctttagaagtattttatttaatgtccaagtattttgacattttttagttatgttactgatttttagtttaattccattatggtctcatagcagacattgtatgatttcttttaaatttgtttaggtgtgttttgtggcttagaatgtgtctgtgttggtgaatgttctatgtaagctttagaagaatgtgtactctgttgttgctgtatgaagcagtccattgatgtctattatatctggttgattataagttcaattatgtccttattgattttctgtctgctggaactgattatatctgatagagggatattgaagtctccaaccaaaacagtgggtttgttggattttttccttgaaattttatcacattttgctttatttttttggcactgtgtctttaggcacatccatgttagggactgttatgtctttttacggaattgacacctttatcattatgtaatcccttctttatatctgatagctttccctggtctgatttttcttctgtctgaaattaatatagccactcctactttcttttgattagttttagtaaggtatgtatttctctattttcttttaatctacaagtgtctacatatttaaagtgagttttggctgggtgtggtggctcatgcttgtaatcccagtgctttgggaggtagaagtggactgatcacttgagcccaggagtttgagaccagcttgggtaaaaccctgtctctacaaaaaaatacaaaagttagccaggcatgctggtgtgtgcctgtagttccagctacttgggaggctgaggtgagcggatcacctgagccctggaggttgaggctgcagtgagcaatgatcacaccacttgcactccagcctgggtgacagagtgagaccttgtctcaaataaatacataagaaaaatttttttaaaaagtaggtttttttgtagacaatatatagttgggtcttgtatcttcagctgccttgacaatctgtcttttaattgatgcatttagaccattgatatgaagttattattgatataattggactaacatcaaccatacttcttgctattttctattttttgcccttgttatttgttcctgattttttttcccgctcttttttggccttttgtggttttagttgagcattttatattattcgattttctctcctctattaacctacctgttatacttctttttagtgtttgtcctagaatttgcattatatttttacaactaattcaagtccactttcaaataacaccataccactttacaggtagtcagagtttcttataataaaagaaatactaattctgccatcctgcttcttgtatcattgctgtaattcattttatttttatataagcattcataagcctgccacacacaatcatacgtaattacttattactattattattttgacaaaatttatgtattagatcaattaagaataacaaaaattaaaagtctttttttaccttatgccttttctgatgctgtttttttttatgtagatgtgaaattctgacctttatcatttttcttctctctgaagaatttaacacatctagtaaggcagatatactggaaacaaattctctgaatttttttttttgtctgagaaagtctttttttctccttttgaaggataatttcgtggggtatggaattctaggtttgtgggttttttcctcttaaaatactttgttttactctcttcttgcttacattgtttttgagtggaggtcaggtataattcatatcattgctcctctataagtaacatgtatttttttctgtggatttttttgggcgactttatctttgatttctatgatttgaaaatgatgtgtctgtatgtaggttttttttgtttttttttttggcatttatcctgcttggtgttctctgagtttcctgggtttctaatttggtgtctgacattaatttgaggaaactcacagtcattattgtttcagatgtttcttctgtttctttctgtcttttcttctcttgtggaattcgtattacatgtatgttacatcttttatagttgttccacagttctgaaatattccgggtttttttttggtttgcttttcagttttggcagtttctactgagataacttcaagcttagagattcttttgttagccatgtctggtcttccagtatgcctgtcaaagggaaaaatgctaacaaggaggtcttactcagaaggcagcccaaaaatttgtataaaatttcctttagattgttggctaattcctaagctgcccatgtgtaatgcaagacttcaggaaacccagcagaaagcaaagtataaatttgactatttgcatggtgctgtgtatctacaattagagttcaggccctgccacattagcacctggggccttcctttgagaccttataagggccacaccctaggaataagtacagattgaaatagattagtctgagcaatcctaattccagtcctggataggaccatgatgatgtacttgtattctgtctgcttgccaaagaatggttaacttactttaggggaagatagcattatcaaagcctctataattttttacccatgatgtcatctgcttgatacaaaattatgaggtatactaaaaatagaagcaattgaattaaatataataaaaaatcaataatataaatagacttagagatgattaaggtattagagttgttagacatggagtttatgattaattgcttaaggaaaaagacaaaaaggtggaagatttccaaagagacctcaatccattaaaaaaaagcaccaaattaaattgtgaaactggaaaatgtaaggatacaggtttgaaggaaaaggatggaaaaaatataccatttgaacactaaccaaaagaaagatagcatggctattttactaagagataaagtagattttaagctaagaaatattactgaaataaagaaagccacttcataatgataaaagtgtgaactgaaagaaagaacaacacagataattctcacaggtgtaatattgagtaaaaaattatatactatatgatttcatttatatgaagttccagaagagagaaaactaatctatggcaattgaagtgattggctacgtctgttgaggatttagtattgccttgaaagggacatgggacagtctcatagggtgcttcagatgggtggtggttacagatgtaaaaattcattcagctctacccttcagatttgtgtgctttattctgtgttattttttagtaatcccaaagaaagtcacttaaaaaagcaacataattcctaaataaatggtggttttaaaattattagtaatgagtaaaaaatcagcattgtattttcgacttagttttaagcacagtgattctcagtaatggcacttttggttttttggattggagaattattatgtagcatttaccatctttggccaatacccgctaaaggccaatattattgtgacaatgaaagacagacaaagcaatgaaactgctcttcttgcattttgtcatattcttctggatgggaagtcatggcattcctcattgagaaccacaggtagagcattttaagggagtgagtgagtgagttctaggacagggatcatttgccactcagggtacatacgctggacatcttgaaacttacctgtatttatttgaaagctcagaaagattctgtaaaactgagaatactgtgccgtcctcaagattcttaggactttatgagcccttaacatgtgtattgttagtagatacgatacagataaggaatttttcttacctgcaaacattgcttattgtgaatgtttttgacattgtgtggtgtagtccatttagttctttagtcagctaaatgtgaataaaagagattaaaataaaagatgctgactcttggatatctaggaaacattttggaataattaagcttaataaaatatcttcatcatactgaggcatgtcgtgatactattccagttgattgaaaaagaaaaaaagcttgagctgaaagggcaatgataattttgcaaaaaatatgcattctttgaagtctgggacatatttaaaatacatggaaagacatttgttatttggttatggcaagagagttctgtagaaaggcatcatttctagattgatttgatatcactgcaaatgtgcagatctgaagcttgcatagagggaactgcaactcagtcactgctccacttttaaaatataaagcgaacactattattttctagaactcaagtaacttcatgaatactacaaacttccagtctcttcggcctttgccatccattcgaatattggtggataaaattaatctggaacattcagtgccaatgtatgctgaacagttggtgcatgtggtcagcagccttactcaaccttctgataacctgcttcattattgttatgtacactgctatcttaaggtatgaaaagtgaattttcttgtttgttagcatgggtttggctttgggatcatcagataagtttcttttttcttgatgttgtaatttcagagaaatagtactctaaaaggtaagatttaaataagaaataagatgtatttattccaataaattaaagtaagtaataaaaatatacttattttaaagatttttcaattatgtgagattagtagcttgatatttataaatgaatggttaatcataacttttgaataattttatttatcattgatggtaatttttataagcaatgtgaaagagcacttagtttaatatggatgctttgaagactcatgtttttttgaagggagcatttgtgtgaggcataatgaggcataaagagggcctaaaacttttttatgtcacctttatttaattcatgtcaatttattgatgcaagggaaatttattttaaatacaggcatatgccattttatcatgcattactttattgtacttcatagtaattgtgtgtgtgtatgtgtgtgtgtgttttttttttttaacaaattgaaggtttgtggcaatcttgcattaagcaaggctttggtgccattttttcaatagtatttgctcacttcgtgtctctgtgtcatattttggtaattatccaaatatttcacaagttttcattattattttagcattgtgatctgtcatcactgttctttgatgttgctattgtaactgtttttcgggcaccaagaagtgcacctatttaagatggtgaacttggtaaatgttgtgtgtgttctgggtcctccactgaccagttcccccttctctctcccttatcctaatccttgagacacaacaatattgaagttaggccaattaatagccctacaatggcctgtaaatcttcaagtgaaaggaagagtcccataactctactttaaatcaaaagctagaagtaattaaccttaatgaagaaggcatgtcaaaagccaagatgaggccagaaagctaggcctcttttgcaaaacagccaagttgtgaattcaaaggaaaagtctccaggaaattaaaagtgctactccagtgaacacaggaatgacaagaaagtgaaacagccatattgttgatataaagtttgagtggtccagatagcagatcaaaccagctacaatattcccttaaatgaaaagcaaggccctaactctcttcaattctgtaaatgctgagagacttgagaaagctgcagaagaaaaattagaagctggcagaggttggttcatgaagtgtaagagaagccatctccataacataaaagtgcaaggtgaaacagcaagtgctgacatagaaactagagcaggttatccatatctagctcagttaattgatgaaggtggctacactaaacagattttcaatgtagacgaaatagccttctcttggaagaagataccatctaggacttacatagctagggaggagaagtcaatgccttgcttcaaaacttcaaaaggcggccgggcacggtggctcatgcctgtaatcccagctcttttggaggctgaggcgggtggatcacaaggtcaggagatcgaccagcctggccaacatggtgaaaccccatctctactaaagatacaaaaaaattagccgggtgtggtggtgtgtgcctgtaatctcagctactcaggaggctgaggcaggagaatcgcctgaacccgggaggcagaggttgcaatgagccaagatcaggctgttgcactccagcctgggcgacagggcaagacgctgactctcttgttaggggctaatgtacctggtgacttcttaagttgaagataatgctcatctaccattctgaaaatccaaagtgctttaagaattaggctaaatcttcactgctcatgctctataaatggaacaacaaagcctcaatgacagtacatctgtttatggcatggtttactaaacattttaagcctgtggagacctactgcccagaaaagactcctctcaaaatattagcgctcacggacaatgctcctggtcaccctacacctgtgatgaagatgtacagggagatgcacattgttttcatgcctgttaacatgacattcattctgcagcctgtggatcaagagtaattttgactctggggtcttattatttaagaaatatattttgtaaggcttatagctaccatagatagccattcttctgatagacctgggcaaagcaaattgaaaaccttttggaaaagattcatcaatctagatgctattaagaatatttatgattcacagaaggaggtcaatctatttacattaacaagagtttggaagaagttgatttcagtcctcatggattactttgaggggttcaaggcttccatggaggaagtaactgcagatgtgatggaaatagcaagagaactagaattggtgtctgaagatatgactgaattgctacaatctcatgataaaacttgaatggaggaggagttgcttcttatggatgagcaaagaaagtgatttctggagatggcaattactcctggggaagatgctgggaacattgttaaatgattacagagaatttaaaaagttctataaacttggttgataaagcaatggcatggtttgagaggattgactccaattttgatagaagttttactactgttaaaatgccatcaaacctcaaatcaatcatcaatgcctgctgtggagaaatctttcatgaaaggaagagttaatcaatatggcaaacttcattgttgtcttatttttagaaattgctgcagctagccccaccacttttagcaaccaccatcctgattagtaaggagccatgaacatcaaggcaaaaaggttattacttgctgaaggttgagatggtcattagcattttttagcaataaagtactttttgtaaggggtgagggcagagtcttactctgtcacccaggccgtagtgcagtggcatgatcttggctcactgcaacctccacctcctgggctcaagtgattctcccatctcagtctcccaagtactgggaccacaggtacacatgcccatgctcagctaattttttgtatttttggtaagatggggttttgccatgttgcccaggctggtctcgaattcctgagctcaagctatctgcctaccttgcttcccaaagtgctgtgattacaggtgtgaaccactgtgcccagccaataaagtgctttttatttaaggtatataagtttttttttttgacataatgttattgcacacttaatagactacagtataagtgtatacataacttttattatatgtactgggaaaccaaaaattattgtgatatttgttgtattgtggtgatgtggaacttgcagtatctcctgggtatgtccatctggttatgtaaagtgaattattggtagctttccccagctctttcaatttttaaaaaataagtaatacatccaatgcaggtatatacaaacaataacctcaaatgttgaacaatacatgttttagctaagcaagcagagatgtatagtttaaatagaaatagtgtgtacacaatcaacttctgttttatgaacaaaagaaaactataaaaagttgaatttaagaatcagtactggctgggtatcgtggctaacgcctgtaatctcagcactttgagagtctgaggtgggtggatcacttgagcccaggaggtcgagacccccctgagcaaagtggtgaaacctcatctctacaaaaaatacaaaaattagccaggcattgtggttgcgtgccagctacctgggaggctgaggtgagagatttgcttgagcccaggaggtcaaggttgcagtgagctgtgatggcgccactgcactccagcttaggcaacagagtgagaccctgtctcaaaaaaaaaaaaaaaaaaaaaaggtactaaaaaagcactaattttcatgtaatgtatcaaaagattagaggactccacaaataggctcttggcctaattagtttatttgaagttataaagtttttaagtatttgtatatctgtaacgcaaaaataaaccaatttcaagataccagttttagatcacctgcaggtgtatataaatgtaagatgttaacatttgactgttttcagaccattgcagactagaagaacatgttttcttggttgtttttgcaaagccttttttctcaaggatggctcctttggtggaagaacaacagatcacattgcaaaagggtgtggacacagggaagtgtgactcattggggccattattttagtgatctaccataatgttttatgttatatggagagtagcagaaatattttcaaaacctagatataaagattataaatgtactttatactttacaatgctttatactctataattttcagattcaatgctttatacttaagctttatttattgtcacaattaatacatagaagtgtacaattttaaaaaatattggtacaaatttaatatcagattacagtgttaagaatatttgctttgttttttcatgtcaataatatattttatttaacccaatatatgcaaatattggttaacatgcagtcaacataaaacattgacattcagcttatagataaatgaagtgagtctctatactcaagaaggatgttcaccaaaaccattggtcatcaatatagtcaccatccatactgacataaaatttattggaatacttcttcacgatttctacttgtcaatatgttaaaactcacatttccagtgtaatgtaaaagttatttacagtgtactaccgatatagttatattttggaaaaagggcctttgctacacatgctgtctagttttcttttatattttggcttgtttgaatacagtcataatggatacgtttaatgtctcaggaagtaaggtgttaggcagagtgggaatagcattaatatgcgtgggaaaaccattccctggtgttaagtgtactaaatccttttttttttttttttttgagacagagtctcattctgtcacccaggctggagtgcagtggcacaatctaggctcattgcaatctccacttcccaggttcaagcgattctcctgcctcagcctcccgagtagctaggattacaggtgtgcaccaccacacccagctaatttttgtatttttagtagagacagggtctcaccatgttgaccaggctggtctcgaactcttggcctcaaattgatcctcccacctcgacctcccaaagtgctgggattacaggtgtgagccactgcgtccggccaagaatactaaatacttttgaaaataaagccttgaatcttgtcttgaatatttcatttcattttcatacttctactgtgacataggacttttgaatactttcaggatgtggtagagagtttttttttatacggctattgtgatgtgactccatttaccagtttgctataaagtttatagcagttcatattacttgggttgattttagtagcctttgaggaagtttttaaagttttagttttatcatattacagtagtacagtagaggattcgtgtgtttggcattttagtccatatataattttcaattaagtacttaaacaaatccttgagttttaattttgtatactgaaccttggctgtattggctatatgatgaaattgtgtccggagttggtgggttcttggtctcactgacttcaagaatgaagccgcggaccctcgcggtgagtgttacagctcttaaggtggcgcgtctggagtctgtcccttctgatgttcagatgtatttggagtttcttccttctggtgggttcgtggtctcgctggctcaggaatgaagctgcagacgtttgcagtgagtgttacagctcttaaggcagcgcgtctggagttgttcgttcctcccggtgggctcatggtctcgctgggctcaggagcgaagctgcagatcttcgcggtgagtgttacagctcataaaagcagcgtggacccaaagagtgagcaatagcaagatttattgcaaagagcgaaagaacaaagcttccacagtgtggaagggaacccgagcgggttgccaatgctggctcgggcagcctgcttttattcttttatctggccccacccacatcttgctgattggtagagctgagtggcctgttttgtcagggcgctgattggtgcgtttacaatccctgagctagatacaaaggttctccacgtccccatcagattagttagatacagagtttggacacacaggttctccaaggccccaccagagcggctagatacagagtgtcaattggtgcattcacaaaccttgagctaaacacagggtgctgactggtgtgtttacaaaccttgagctagatacagagtgccgattggtgtatttacaatccctgagctagacataaaggttctccaaggccccaccagagcagctagatacagagtgacgattggtgcattcacaaaccttgagctaaacacagggtgctgattggtgtatttacaatccctgagctagatataaagactctccacatccccaccagactcaggagcccagctggcttcacctagtggatcccgcaccggggctgcaggtggagctgcctgccagtcctgcaccgtgcactcgcattcctcagcccttgggtggtcgatgggactgggcgccgtggaatagggggtggtgctcgttggggaggctcgggctgcacaggagcccatggagtgggtgggaggctcaggcatggcaggctgcaggtcccgagccctgccccgtgggaaggcagctaaggcccggcgagaaatcgagcacagcgccggtgggccagcactgttgggggacccagtacaccctcggcagccactggccggggtgctaagtccctcattgcccggggccagcagggctggctggctgctctgagtgcggagcccaccaagcccatgtccacacagaactccagctggcctgcaagcgccgcacacagccccggttcccgctcgcgcctctccctccacacctccctgcaagctgagggagtgggctccagccttggccagcccagaaaggggctcccacagtgcagtgggggctgaagggctcctcaaatgcaaccaaagtgggagcccaggcaggggaggtgctgagagcaagcgagggctctgaggactgccagcatgctgtcacctctcaatcccccctctaaacaggacaccccaattgctgttgggaatttggccgttgactgctctagctacttcctgctggataggggcgaagaaggggccctgcagttgtggtgtccttcagaggggaactctccaggccaggggaagtgccagtgggtcggtccaggggtcccgggtagaagttgttagttgaactcatttggggttccatttgtaagaccatctgttgcttgatggtctcgattctagaggaaacaaaattgacaagaaggttagaaatacagggcccaaaggtgagtaacagcaagatggctgccacaggacctagaaaggggagaagccatgttgcccaactccagaggttggtataagtatttgaaaggcattgtctgatttcagaagccttttcctgtaaacgccgggcagcatctcgtactatccctgactggttagtgtaaaaacaacactcttcccctaaaaaggtgcagagtcctcctttctcagcagtgaggaggtctaggcctcagcagttttggagagtcactgctgccaaagagtctatttgggattgtaaagtaaggatagatttcgttatttcttgcaaactgtctgagaagcaaatatgggttgaagacccacataagtagaatatgccttggctgggtagatagaaatttaccctggcttttaaaggaataggatacactgttttttctttactacttccatctctctctttctctcttcgacttcttctttgtctcttcttctctttttaactctctctttaactttctgtgtctgtccctctttctctctgactccttttctttgtctctgtttctgactccctctttgattttctgtctctctgtctcttcctctctctgtctttttgactttctctttctctcttcgactttttctttcctttctgctgcctctgccagctgcttatgctgctgttctcccctctccttcccgttttgatggctttgtcagtgtaagaaaatgattcataattcccacttcatgtaataaaatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagaactgtttaaatctgctgtcattgattttttaatagaatacattgttatttactatagtcttcatgttgtacaatagatcttttaaatttatttctcctatctaattgaaattttgtatgctttgcctaacatctcttcaacctcctctccccgagagatgacacttgcttatggcttaccaattcctctttatgtatctggcaaacccatcgtttgaatatgtatggtattgagtagctaagagtttcaaggcatctgatatttgaaacatatgtagaaaatttggtaatgtgactgcgttgtgtaatttgtagaatagtatataactttaaggccttattcatatggatcagctgcaatacatacttcagacagaacaaggagttagagtaggatggaaaccctttggattctttggatctgttaattttttacctcaagaaaatcccaggggatttggaggaaataatgttttcatacacattttacggttacataaattggcatatttattttggaagtagcagcatgtaatacatttgaaagcacatctaccttaccacccatttgttccaattttcagtgtataccctccagcaggggtcagcaaaattttgcctacaggctcagtatatattttaggctttgtggaccaagtggcaaaattgaggatattatgtaggaacttaaataacaagagagagaacaaattttacaaatgttgagtttataatattcaaaatgtaataattgagtacagtttttgggtaatacacagttttatttttcttttatttatttatttttttgagatctagttttgcactgttgccctggctggagtgcaatggcacgatcttggctcactgcaacgtccgcctcccgggttcaagtgattctcctgcctcagcctcctgagtagctgggattacaggcacgtgccaccactcctggctaattttttgtatttttagtggagacgggacttcactatgttggccaggctgttcttgaactcctgagctcgtgatccacccacctctgcctctgtctcccaaagtgctgggattataggcatgagccaccgtgcctggccaggtaatacagttttattaatgagaagaatggaactctttttggagggacaacatttcacctaattgggatttcaacttattgttcccaccatgttgattataaatgtttatgtgtaaaaattattctttgcttgtaggctatcccggaacaagcagtgtgtgggatttggcctgtaggctgtagttggtttttgttctgttttcttagaggtttattgtttaggaattaacttaaccaaggaagtgaaagacttttgcaataagaaccacaaaacagagctgaaagaaacgaagatatacataaatggaaacgcatctcatcttcttgaattggaagacttaatattgtccatgctatcctttctacacattttcagtgcagactctattacaattccaatgtcttttttcagaagtagaaaaactcatcctaaaattcatatggactctcaagggaccccaaataaccaaaaagatcttgaaaaagaacaaagctgaaggacttactcttactgattccagaagctactacagagctatagtaatcaaaacagtgtggtactgttgtaaacacagacatatagacccgtagaaaagaatgcagtgcccagcaataaaccattgtgagaaagattgtttatttttctttaagaataaacagagaatcagccattcctttttaggtgaagagaaggaggaaatagaggaaggaaggaagatcgggtgaaattttgagttaatagatgagctacatcaaatgaagtatcatatccttgttacatcaatatataatttcaaagatgtccctaatccttttggacttcatttttcctgcatgtgaaatgagatgattgagttaaataatctctaagcagtttgagctctaaaattctttggttgattttgatttcattcttttcccctgaagagtttttcttcacaaggtgttcattattatgctgtacaaccctagttattattattctttcttcagtttttatgtgtttcagtgtattattgcatacataccaacttttaaaatgaaagaaatgcttatttgttcctttagtgaagggacaaatctttatgatgctgattatactattatgtgttttatactattatgtgttttatttaatggtataaaactaccatgtgttttataatggcagtaacaaaaattatttattgtatatcataattataatgtttttattgtcatttacaattagcatgtgctttttatacttttgtctttttaaaatagcaaattctaatttatgataatttttggcaaaatcttacagaagtaagttgccatataatgtttctaaatccattacaatttcttctatttgagatattaattcaagaacatttgttgtaaaatgttaaaatcttgatgatgtattcatttttgttatttactaattgggatttttaaaaacaggtggcaatacatgtttaactttttatttaatgagatgtgtaagttctcttattcaactttacagtttcctttagctaaaatttctactggtagttatacttactgtttcatacatttttattgctccagattattagtttgcaacatttaccaaaccagtttttgaatatgtgagctatccttcatgaaagcaacttcagtttacactgctggttctgctttttccagattaagtatttatagtcttggtcaagggatgttgacaaattattagcttatataggttttgtaaatctatgtatctgattgctgtaatttaaaagagagagtttaaaaatttatttttaaatagttctttttgatttggtggataatagaggaagcaaaaatatgactcataataatttggcaatatttagaaggtaacttctttgtccagtaggtcctgttttattgtaattttcacctggttgaatgttttcttagaagcatctctaggcaacacaaaagtataataaagacttttaaaaaaatgacagaatagtatgtagtttccccaaagccctttgcaattctgcagacaaccagcaggggatctcgtctacacccaatttccttctgagtacagttggtagatagtgtctgtgattatactgttggggcatttaatggaaaatttgacagtggctttgagagagttcttagttgagcataggtaatatgatgtgataaaatattatctttattcataactcgaaatatttggcagttggatattgttttaaaaatgttttgtattgttataataataactgtaaattccagaatcctttgaatatttggcctttatgaggaaataagaaatcctgaaattgtacagaaaccaacgcagtactttgcatacattattgctcagaacaggtcttcaaaaagaatgaatgtgaaatatcttaattttaagttatgattttaagtaatcatttcagtattagaaagatatctttttctcaattctgtacttcttatctattggttaatagcaggttataggtgctgatgggtgcatcacttttgttttccttgatagtaattacataagtaggttctttgaaatgcagttttccttgaaaatgtaattttaaaaaatgttttatttctaaaacattgttttgttcactcaaaactgagtgtataagaaataatttgacattgtcgatttgatgaatgttaggagtataatagctttttgaaactatttggaagtagcttaatacttttaaagaaattgataattattttatgctcattaaatagtattttgaaatcagttatgaagaaattctaaacatattttattatagaacttcacagttgatattaattctagagatatggaagtcagtgctttataaacccaagggataaaaaacagtaactaaagataaatgttgagattaagctacttttacatttactggaaaacagtaactctttgttttgtatccatgtgtgtatttccactctgaggtgtttatcttttgttgttttacaaataattgaagcagaaatatcatcagttctctacagtatttcatgtaacgtgatgttatgttgtttctttctattatgacaaatatagtatccaggaatttcagggattgcttataaaattttgtagtatggtctgcttgctttaagcatagacatgcttgtacatatgaagagtaatttatgccatgtaccaagttttctggggtttaaaacctcaatcccacaattattttcacaaaagaaaatagaaataacattttaggatatttttcgatatcctttttgtatgtacattatacaaggtgaagacaaaatacatttttaaacagtttttcttgtagttaatgttattttagtcataaaatattaacattaatttataaaatttgtagtttactgtgtagaaaatgcagtcagcggtttatatttatggaaaaatgtatattttagcagataataaaacactacctgaggagtatgtatagaaataaaatgtgaaacttaaaaaaatttgtcaaaagagcagtgatctttcagggatgtgaaataaatactgtatatttaagtttcttaattttgacctactgtcaaattgtatagaagaaaatgttgatcgtttgggaagtggaaaaagactttggaacatatttagtgtgcagctgttgtaaagcaagttgaaactgacgtatttcatcctgtgcttattaaaactttgtctgtgtgaacacttgcatcttttctttttgttttagatatttggtttccaggcaggactgacgtctttggattgcagtggatcttactgcttacctgtaccagttattccctctttcagcactgctctttatgggaaacttctgaaactccccacatgctggtaagtcttacatgttaaaatgtgatttatgttaatttccatttattaggagggaaaaaacccccaaatgtatctgtcttatgcccatgctagttttatacaaaactttagaaaaaaaatctaaacttgtacttttactgagacactaaaagtcttttttaagtttctgaaatctgttagttcatcatgtcttttgtgatagcaataactgttattagggtaataactgttaattcatgttggatgtgtgtaaaatactacttgagattataataggaactgtaagaggaagtgcctttttttcaagagtgggtataaagattttaaaaagttataaattaatattcaagaccaaagtatttatctattaaataataatttcgtatatattcatacccactgacaaaagtatacacattatgtagagttagaatgtatttacatgtctagtagctatattttataagaaattgattgtagccctcaccattttcattccgaattgaatgctatatttggaggtcacatttccttaaattcggagagatttacagaaagaaagccagtagttaccagttataaatttttagtttaaaggaatgcttttaatatattgtttaaatatataaaataatgtttaaatatatgaaattaatttttagtgaaccatttttccaatttaaaatgtgatttagaatatgtcttttgtattctcattctaattagtaagcttatttttgcaggatagtttttctattagttttttactaaaaatgacataacctttagaaaattagcattaatttcttatctaaaatacttcagttgctaaaaatttgtttctttaataatatataacttttaaaatgaaattataaaataatcgctcatattttcaagaaactttgcctgctgatacagaaaatttttttaaaagtcgtagttaagtcttagtaccaattcctctataaagtgaaaccattattaaatgataattcttaatttctagtgataaatttcattttgtccttactcctccatacctctcacatgtcatttattatgttatatagagatagatttaactttttattagcatacatggtatgttgcatttgagtcaagttttatattctgatctattaagaaataaactgggatatgtcacagttgatatggtgatatcaattttaataggtatttgtgaaaactattttctccgttatgtgctgattaatttatcatttctaggaccaaaatagttttattgcaaacagtgcaatttactatagaaaattcttaatttctttaaaaaagtccatatttttcaaaatgattatagcctttatataaaatcaatattgaaataagtaagacttatttgaaggatacaaagagggtattatgaatactgtcaaatgttacttaaaatatgcctacagacatctagaaataatattccaattaaatactgaaagcatgagatcacagaatgccaatattttttggatgtgttttgcttttttgtagttaagactacttctgtgttatttcagtgatatttttgctatgctttatagaagtatattgatttgaaatatttcttgaaattttcttaataaatgtaaaaaaaaactttagtaactgtaacttgaaaataaagagaaaacttaataaattgagatattggttggttttagtgcagtttgaattcaataaaatactgcttaagcagtatgtcctataagtttaaagaaagcagacagtttccctgggacgtcagagatagctgatgagatgaggtcctgttagaattggacattagtggatgagacagatatccatgtatctatcactgcatacagtgggcgaagaatttggacagttactctaccttagacttgtccatgagcaatgatatctaaatgttttaatatgaacacttaaagatagttaaaccagttaatcaaatattcattagtcccatttcttcatgttcatgtttgttaaagcctaactaaaatatagtctcaaattcactttgtcctataattgagggttcaaatgtgtgattctatttgtagagaaatatatgcaacatattttggaagtttggagtatagaaatagtatattggcttagaaagtcatggaaaacatggaggggtaatttttaagcaggatattgaggaatggatataatctgaaagagcatactatattgttttatacagtcttaggtacctagttaaagttcatgacggtcctgtgagataagatgatattgtctcttataaactctttctaattttcagagaggttaaataagttgtccaaagtcacacactggcctcacaagattttcgtagaggattgtctgatttgaacatctttgattgttttattacttgaaggagcgaaggggacatatataatcttctgttaatcagttttgaaggccctgttaatcagttttgaaggcccagtatgctttttgcctatagttaaagtaaatttccatggagtgaaaggctagctaataaatctgaactctgctagtattagttaatagtatgtagatattattgtaattctgatcttaaaatgatggatattaacattaggtggaatcttagacattatcccagttactgagtctttatgacgtacttttggtttatagccatctgtgtactgcttgaacattttattcaaggatgttagctactttctgggccaaccattattgggcagctctaaatttctttcttttatttaatcaaagtttgcttttatgagaagtttatacttggatttctgcctaagaataatgtttcttctctgatataattattacttatatatatcatgaggcattttcattctcagagaaatgtgtgaaaacacatatttctttttaaggttgagggacttctaagttcccattttttacttagcacagtgccaattgttgattttaactagcaaagttattgaacagatcatttgcaggggaaaaatgcttctgtgaaatctttgagttcagtgttaattagaagttacacgacttggtgctggtaggctggtggtattgatgtggtgtgtgaagggcaggtgaggcagatactgatccttttgcctccctggaagtgaaactgaaggcatcatttgccccagctcagagtgacaccagggtaaattcttttagttttaatggatactgggaccttcaagtctaaaaaaaattgccagtaatacttattatcaacacaataagtaaccttccagggcttaaaatgatgtttatacaactgccctgttcttcgtaataccacagttcgaggcctcaagaagctatacttgagtgtttttaatgaacctggagatagatcttccttccaaaactgtgttcatcagtctggttttgtgattaacattccctttaactaaatgccttaaaactactaagccttaaatgggatgttaattctcttatctccacctgataggtgttagactgatttttcagctttggttctgccatctaagatgtgcttttatggaatgttttgaacaaaaaagaaacattaacatctgttacaatcttctcatttcaaagatgggaaaactgagttccagagaggtcaaatttcttgcctaagaccacacagttaattaatatcagtgcctcaatttgatcctctccttcttgattcaaggctcgatcaactgtaccattttgcttaaaacaattgctattactatttcaaaaaataactatttttaaatgtaaaattcagtagcattaagtacattcacattgttgtgcagtagtgccaccattcaactttctgtctctataaatttgactattctaggtacctcactgaaatggaatcattccatatttgtcatttgtgtctggcttatttcacttagcataatgttttcaagattaatccgtgttgcagcatgtagcagaatttccttccttattcattcgtttgtaagactgaattttatgtattcattttatgtatatgccacattttgtttatccatttatccattgacaaatacctctcaccttttagctattgtgaatgatgctgctgtgaacatgcatgtacaaatatctgtttgagtctctgctttcagttattttgagtatatacctagaagtggaattgctgtatcatatggtaattctgtttttgagagctgccatactgattttcacaccacttgacacctgcaacagtgatggaaaaaggttccaatttctccatattttcatcaacacttattattttctgttttttgataatagctatcgtaacaaatatgaggtgatatctcattgtggttttaatttgcattttcctaatgattaggaatgttgaccatcttttcatgtcctatctattcaagtcctttgctcatttttaattagtttttttccttgagttgtagaagttctttatgtgttgtgtaaattaatcccttatcagatatatgatttgcaagtattttcttccactgtgtggaaccatattgcagggtcctggctggagatgcatcaataaacaaaataggcaagttatttcccctcatggcaatagagaataaacattctcttaattaagggaattttaaggagagaaaaattgctccatgtagattgtcttttaaaattgaatcataaaatcatcctttttgctgtactgagccttgaaaggaggtgtttaaatagttcttgatagcataacacttttggattacttaacatttttctatttattattttttatgtttcagtgaatgcagcatttttactttttcttaatgattcatgtttgaactgaaaaccatcgaattaggagtagagcaaacagtgataggaattgaaatatagattcttgcagataaatgaaaaaacccattggataaattaaatatattttttatttgccagctctgaaaacattcttcagttattgttgaatgatgttgtaggagggtgcatttgatgattcaggacttaatgcaagcttttctaaaaacttgatttctcatcaagtattttaacatgtacagcttgaacaacatgggcttgaactgtgtgagttcagtttctttcaataactatattggaaaatttttttgagatttgtaacaatttgaaaatttgcagatgaaccatttagcctagaaatatcaaaataatgaagaaaaagttaggtatgttatgaatgcatacaatttatgtggattttgtctattttatcatttactaccatgcaatatacaaaaatttattataaaaagttaaaatttggccaggaatggtggctcacgcctctaattccagcgctttgggaggccaaggtgtgaggattccttgagcccaagagttccagaccccatttctagaaaaataaaaaggtaaccaggcatggtggcatgtgcctatagtctcagctgtttaggaggctgaggtgggaggatcacttgcgctcgggagattgaggctgcagtgagccatgatcatgccactgctctccagcctgagtgacagcgagaccctgtctgtttcaaaccccaaaaccaaaaaggtaaaatttgttaaaacttatgcacacaaatgcttagggaccacacatggcaccattcagagctgatagaaatgtaaacaaacataaagatgcagtattaaatcataactgcataaagttaattgtagtactacatggtgtactactataataatttcgtagccaccttttgttgctactgcggtgagcttttgtgttgtatctgcttaaaatgctgtgtgatggtaagcatctccatgtgagcagtccctgagcagttcctctctacagtatgactgtgtattgcaatagaaagtgatctgtcacagttctcacatatttgtcattgggcttagtgcaatactgtaaaatactataaacttttgttttttttttttgagacgaagtcttggtctgttgcccaggctggaatacagtggcatgatcttggctcactagcctctgcctcctgggctgaagtgattctcgttcctcaacctcctgagtagctgggattacaggtgcttgtgccaccacacccagctaatttttgtatttttagtagggacgaggtttcatcttgttggctaggctggtcttgaactcctggcctcaagtgatctgcccaccttggcctcccaaagtgctgggattacaggcatgagccaccgcgcccagccctgtaaaccttgaataacaccacagggtccacacagagtgattctggaagtggttccaagaagcagaaaaaagccatgatgctataagacaaagttgagttgcttgatatgtaccacagattgaattctgcagcttcagttgcctgccctttcaagaaagataaattcagcataaggactattgtaaaaaaataaaaaataaaaggaaatctgtgaaaccattgcttcagttttgccagctagcacaaacacttttcactttttgtgaaatacctttttattttgtattgaaaatgcagcttttatgtgggtgcaggattgctataagaaaggaatactagagactctaataagatttgagaaaaagtgaagtcattatgtgacaacttaaagcaaagagaagatgaaggatctgaaggtgaagaatttaatgccagcagatgatggtttgacaattttagaaagaggtttggcttaaaaaatttcaagagaacaggagaagtactttctgctaccaagaaactcatattagtcagcagatgagtttcctaggtgccattaagaaaattattgaggagaaaggatatctacctgaacagattttaagtgcagatgaaagtgccctattctggaaaaaaatgccaccaaggacatttattagcaaggaagtgatgagtgctcacagacctgtgccagatgataagaagtaggagaagcagtgccagaaaacaaatggacattgtacagtctggcagaagggttccagttattcaagattgcctttgacttttttttatgacatggaccatcctatgataggggcactgcattatttgaaataaatttcttggaaagactgaccagtctttgtatatgttaatggtcttgccaatttctgtttttccttatatttttggttgtgatttgataatgtgtttagataaataacttgtcaaaaaatacatacatttatagtttttaaaacatggcctatgtgtatgaaattaaaaggatataaaaagcacaattataggtaaatagtatgtatctttatattagattttttccctttaatttttttagaaagggcacaaagagcatttgacttgacatatgttaacaagcaagagagtgttggtccaatgagaacagaaagtttcctttgattgtgattttggaaaatttgatattttccacatggaattttatggtcagttggggtgaagttgtataggcaaatatgatgcatttccaattccctagtttaatgttttaaacttagtaaaatagtttgtttagtggtgtccaaatgagcatttacaactcattcttagcttattgcctttaaatttgatttttggttattggagaatatttctacatgacctatatctatgtcagaataattatattgacttttcctcagtatttggctttgcctgtgcacagcagtgggaaaatattatcctgtgacaacattctattctagtgacagcattttaaaaaatgtatctttctttcattatttttgtgagggagagtgaaagtcagtagtattctttgagttcaaaagaactctacgttgttaatgtatttttttttaaagcgaaatggcttggttagtaattattaaatttagcctaggttttctttttatgactacctttaaatttttttcttaactgtgttttgatgatttaatttctttttattttttattttattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccttgaaatgtaagaacaaataatcattggcggttcccatattcaaaagatcagatagtgcttaggttagtgacagaagaaaatttctaataatagcatcataatccccttgtatagcattttgtacttaactaagtttcactgcatacaggaagttttttgatactcacaaccaacctttgaaataaacaggttaggtatccttatttctattttatagatctggaaatggaggattagggaaggtgatatggtagacctagagagataaaatcgcttgcattggacatcttttatttattttattttattttatttttctatattttgagacagagtcttgttctgtcacccaggctggagtgtagtggcacgatctcgactcactgcaacctctatctcctgggttcaagcgattctcctgcctcagcctcccaagtagctgtaattacagatgtgtgccatgacacctggctaatttttgtatttttagtagagatggggtttccgcatgttggccaggctggtcttgaactcctgacctcaagtgagccacccgcctcggcctcccaaagtgcagggattacaggtgtgagccactgcgcccgccctagacatcttttgattaattgatgttggaactattaatagcatgttgattaatagctattaatagcaggttctagataagaactttgtattcttcattatgccttataacttaaaaaatactgccagcttcttagaagaatctgttaatacttaacattgttcagatttcaactgactaatgagtcatttattcattaaaaaaaaattttggtgcctatcatgttaaaactgttgtgttgtaggccttggagtgtgaataccacttggtctttgtgtttcctttcttgatactttaagaatttagacaggtgttcttaaatactgtctaactcatacatctgcagccaagtttgtttgtttgtttggcttgtttttggaagatctaattatgacctctttactagaatactttgcttcttacaatttatatggtaaagtttaaaagctttaaaatattctttgatgccctctatggtctggcccctgcttggctttctacactcatctgaaacgtcctcctctctgtcccctccttcttgcttttaaaaattttctctccttttaccaaattgttcactattattgttttactattctgtatcctaaataactgtaactgactccagatgctactccagttgatactttttctgacctggtcacttcccctctaaaatatgctttaaaatatgagataatgttcttgtttttcattgtacttttcatagaagtgattttacactgctttgtgtgattatttaatagcctttcccactcgttttattttaagctccataagaaacatctctttttctgtggggcacgtttatcgtgaaaacctcgcatctgttgtagacatgagtaaatatttattggcatgcgtctggctgtttctttaacaatttcaattttttttttggttttctgatttatgaggttttagattgtatacttttttgacaatcaagttctatctcctattagctcacattatacatgcaaaacttactcttggccaaagtgaaaatcagtgatgttaattacttaaattaaactaaaattttagtgacttttcctattcagagttctcaaggtaatatttgaaagttattaattacatatataaaatatattgtataaacacacttcatctcctttttttcctgagcagttacattcttattttaagtagatgaattgtctgttttaaattaacttgtctagaagatgagataatgtaaaggcatcttacttcttttgtattttgtttgtttgctaccacacatcagttaaccattatttaagctgttccatattccgtaatactagcaccactttttggctcatatcgagcaagtatagtatataggccattccctccagagacttacaactcatgctgcaactcatttataaatatttattgggtccatggtataattccagtcatcattctacatgctgggaatgcagtggtaaacaaaatagaccttgtctctgtttcatggagccaatattctgaagaggtagagccaacactgcattaagacaaatacatgcatttcagataatggtgagtaataagaaaaattatggccaatgggatagaaaatgaatgttttggggagtttatttgtctaaaatggtcagggaagttctcttacatggatgtgacttttgactccaacctaaatgaccagtcaatggcagccatacaaagattttgggaaattgtgttgcaagtgttgggaatagctggtgcaggtctcaaggtagaaatagatatagttcatatgaaggacagatagaagtcaagtgtgactgcaacatagtaaagggagatagataagagattaaattggagaggtggtctattcacaaataaaagcaacgtaagtaggtataacctgaacaatttttagccttaatagtagagaagtaaagatttaaacaatgtagaattaaccatcttttttgtgtactgttaaatgaatataatattcagaatgttaaggattgtgacaccagtggtggaaatttaatatgacagatccttacaacttttctgctgtacagcttgactatatccatcaaaatctgtaagcatgaatatcttttactcagcatgtccatttttaggagtttgtccttagatataattaagcgaatgaccaataattagttatgataaaatggaaaaatgtaaatagcaaataatgaaaaacaggttgtataaattatgttacactcataccagttagcaatatgtaggatagccattaaaattttgttgtagtatatgtttattggtatagaaatgttctcatgataaatatcgagtgaaaaaaggtcacagaacagagggatacagagttagtctattaatctgaacaaaaaatatgcttgcacaggtaaaaaggctgggctattgctaaactgtttgtgatggtgttatgtgagtggtaggtaatgtgtggtttatgtattatagtggttaggagcatggacctcagaactggattccttgcatttaaatataggctctgccacttcctagccttgtggctgagaaagtctttgtgtctgagtttcctcatttgtaaaaggggcaattcttaattcttaccttcgagttattttgaggcttaaatgagttaacaaatatgagctgctttgaatagtgcctgacacataacaagttctttatgcaagttagctgtgattattactattgcatatttacttttttctgacttttttcagtgaacatacatttataaaattgatgggtcacctttctctcaaagattgtataaagttttatttgacatgccaaaaaggaaaagtttgtttttaatcacatgtattaatataataggtataatctattaataaatttataaacttctataaagcagttaagaaaataaactgaggaacagactgagtaaaaagatgcacaaaacatctgaaaaaattattgtatacagaatatatgaaaatatcctacagttgaataagaaaaaatacaaccaattaaaaaatgggcaaaagacttgaacagacatttcacaaaggaagggtcaccaaacacataaaaaagaacccaacaactatacataagggaattgcagattaaaaccacgttgagaatgatcataacagctttattcaaaataatcccaaactgaaataaccctggagattaaataaattgtggtatatttaaacaacaaataccactcatcaataaaaaataatgaactactgatatatacagttgtgtttcctgagtgaaaagaactgggcacaacagaaacatggtatgattctatttatatgaatttctggaacaggcaaaattaatctgtagtggaaaaaagtctaaattgcctttgggaggatgaaggaggaaggattgattgggaagaacacagggaattttctggggagatggtgatttcagtatctttttggggtgagggttataacacagttatgagtatttgtcaagattcatgaaattctacagtttttagaatatataaaaagaatataaaattctttttatattttactgtttgtaaattttacctaaagaaaaaaggactgaaaacaaaattgaaatctgtttgcttttttgcagtggaatgagttagcaactaatgatatgagttaagcaattcttaaagcactttctgtgtattctaggcttgactaaataagtaggcttattcagagtaatggtatccaggtttttcacctgtggagaaggagttacaaatatgttaaagagaaagtctatatttatttatcgttttatttcttctttgagacggagtcttgctctgtcacacaggctgtagtgcagtggtgcagtctcagctcactgcaacctctttctcccaggttcaagagattcccgggcctcagccttctgagtagctgggattacaggaacccacccccatgtctggctaatttttgtatttttagtagagactgggtttcgggtttcattatgttggccagacttgaactcctgacctcaggtgatccgcctacctcggcctcccaaagtgctgggattgcaggcgtgagccaccgcacctggctgtggaagactatatttaatggtaggccgtcatggaaaaaaaagaggaggaagactataattcaccttggtattgtatttgaattggaggtatcagaatgaactcatggtttttaatacaaagatatgtcacatttacacctttttgttcatattgttgccgttttcttcttatttaacatcagtacttttgttgaatttagacactaggttgagacattatgccccgctgctgctctattgacggtatattgaagtttatataggttaatggggtttttgtttgtttttcttttttttgaagaattttttctttgcatgaaattttactctggagattaatatgtaaaaagttcaacatacatattgaaatgctcagatggaattggggagatatgcagcctagtagtttgcatttggtctctgcatggcagatgtttggataaacaatgaatatcttttggtatgttagatattaagttctcagtaagcacagagtggctttttaactgtattattgtgtagcatcgaatagtatctaatacttagtacttgcctaataaatgtggacttaaattgggtattttttcttttgaattgtagtgtttcagagtgttggaaaatcttagtaactaatatataaatatattttttcataaatgtagtattgaagtaataaaggtaatccttaagtaaactataagtattcatttttaaaaaatgactatattgaggtataatttacataccataaaattaatctgtttttaagcatacaattcaatgatttttagtaaatttaccaagttgagcattcatcaacataatcatgtcaccctaattagatcctctttgttacagttaatcctaattcttaccccaacttcaaggaactgtagatttactttctgtatctctagaaatagaaaatatctctagacatgttctgtccctggaatctataatatgttgtggtcttttgtttcagggttcatctaccttgtaacatgtattagtacttcacttctttttattgctaaatagtagtcaattggttggatagaccactttttatttatccattcaccagctgatagacatttgtgttgcttacacttttaaggctattatgaataatgctgccatgaacatgtagtctttgtgtggacttaatggtttcatttctcttgggtagatacctacaggggtatggttggattatatagtaaatttatgtttaactttttaagaaactgcaatctgttttgcaatatgatatcattttatattccttccaacaatgtatgaggttcttgttttttcacagccctgctgacatttgttattgtctgtctttttgattatgtccattccagtggggttgaaatagtatctcatggtagttttataagaattcatttttgtttgcttagttcattttaagattttggattttatgtatggtaataagacatttattacacttttattttagtggtaggcagcttttcttatattttcctatttttcatctaatattttaattcaaataaaactattccagaaatttgaaaaatgttaacatatttttatatctcgacaaacaggatataatttgtattttatttgcaaatgctaaaatcattgtaattaaaaatatatgacaaaagctggccaggcatggtggctcacacctgtaatcctagcactttgggaggcagatgctggtggatcacttcaggtcaggagtttgagaccagcctggccaacatggcgaaaccccgtctctaccaaaaatacaaaaattagccaggtgcagtggcacgctcctgtaatcccagctactctggaggctgaggcacgagagtctcttgaacctggaggcggaggctgcagtgagctgagatcgtgccactgcacttcagcctcagggacagagcgagactctgctttgaaaaaaagaaaaaaaatggcaaaagctaatggatgttgaaaaagatactccgatacactgctgacgaatgtgaaaattcagcgtgatatcatgtatgcattaaaaagaccactgtagaaggatttgtattcatgtaaagatcttagtgatctctaagatatgttgtttactcatatcaagtaggctgtagacatacacctatgtgtatattctcattaaaattataaatgtatatttgagtgcatgaaatgaatatacagaggtctgcagggatatatgataaactcataaaaagttgttacctgtagagtgtggagttgggagtaaatagtattagcttttcattttatctatttaattttttaaaactttaaaaactttttttcttttcattgagtattgatgtgtaagttaagtagtcactgtgtaaagaaatatacatcttagctttttaaactgttttcatttctaagttgagttagcaaagaactgtactcattttattttggaaaaagtgaactaatcttattttactgtacaggatatgagtaataacaaaaatacatttttggaaccagtttgtaggttcaaactttgcattttgggactctatataaatctttagatccagctgttgctgagaatattctttcaattgctatgaggtgtgttgattttaaaagaatggatggctgttcctcaagtgtacatatggcaaaaatttaatggtatcgctatgaacttgaatggattgtttaatttctttgcatcgagtagtaagaaccacacttccatcatttttatttaaaatttagaagaaggaatttttttttatagaaatgcccatttggtcctgaaatttcatcagctctctgttatagtttgtcaacaaatggtacaagcaaagtctttcaaagtatttgttaattaggccatattcatttttagtcttcgctactatacagtcaagacctacttgtttctatttcctttaatttatcctggagtttgtccaagttgagttttaatgagttgtttatcccactagttacactaggatttatttttccctagagagtaatgtttgaattgatagtttttaaacctattctgtaaaatgaacatatgttcagactaagacttctggatatgaggaataggcatgtgttaaagaaattattttatattcaacagcttaactgttaaaatggaaatttagtgatatttcaaaatattaggtaagtccagaagttagaaatttttggtatgaatttatattgaactattttgttttaagtaaagtttaataaatatgtagtagtctaaatcacaaggaaaaatacactttttattgtgcatttttattgacactttaatgactcccccaaatagtttaaataaagttgtaaaagctgttgatctttaaaaaattttttgaggtgaatatggtataatgttatgtcttgatgaattggtaatagatacattgagtatttgttattttctacatttgttaaccagttacaaatatttcaaaattgacaaaaacaaaagagaaaaacccctcttcattggtattgttacattaacagataattgtgtaagataccatctatacccaaatcattttaaatttatttatgtcagtttaaatactactggagtatctaacagaagtataaatagaatgtatttttatttgttgtgggttacagctgaaaaataaaccacaaagacatatcctgtgtgtataattggcgtgtttattattgaattctaacttttgtacaaagtaagcttctcctttgatattaaaataattaaggagagaatttttccctacccttgggcattactaaaatgtacaatatattaatctttctgaatttgcatgtgtttaagtttttattcaagtctatgttatccatttgggaacattttaggtgatataagctggcttgaaagggtaccatatacggtagctgaatttattatgaaatagtaaagacctgcttgtaaaaaaaatgaatcccatctataatattgccatacaaatacttactgctgtagttatatgaacatggctcttgctacacgataggacctcctaattgccacagagtgcctgaagatagattaattgtacattttcgtattataggagatattccaaatatctgtgttctttactacttatcactaataaaatgttgtgggttttttggtgcaggggcggggggcggttcaggaatttgaacagaaatttgagaacatagtggagagacctagttaactattttaaaatgcttatagaataaaaaggaaaatgagaaagaaaagaaaatgtctttaaaaatattctaaatgttggaaaagcgaaaggaaataataaggataattacattcagatttatgaattgagtcatatttgtttatccttctatttcttttgatctctactactttacctgtttggcataagggatcttttatttactgcatatttattttctggtccattcattccaatcctttggcttttatagccaaatatgatcagaattgtggattgagggacacaggtagtgtcacatgttgctattaaggatttgaaagttgttggatgggatagtggctttcttattgggcaactgtgtatttgattgatcttacatactaattaagagagatgggtaggccgggtgcagtgactcatgcctgtaatcccaacactttgggagggtgaggcaggatgattgcttgagcccaggagtttgagaccagcctgggcaactaagtgagatcctgtctctataaaaaaataaaaattagccgggcatgctggtatgcacccattgtcccagttactcgggtgactgaggtgggaggattgcttaagcctgggagatggaggctgcagtgaaccgtgatcatgctactgcattccaaccagggctagagtgagaccctgtcttaaaaagagagagagagagtgacggagacagagacagagacagacagaggcaggggtgaccctaggcttttgtttttgttgtttggacattttttttttttttttttttgtgagggaaggcattggtatttgaatcagttttgctaagaacagagttctaatactttagggacctagtttgttttcattgagctaaaatttacaacataaatttcatcattttaaagtgtacaattaagtggtttttactatattcacagttttgtgcagtcatcaccactatctaattccagaacattttcaaaacctcaaaaaagaaattctgtctctatgagtctagacattttataataacagaataatataatatgtgactttttggtctgacttctttcagttaatgtaatattttaaaggttcatccatgttatatagcatgtatcagtatttaattttttatcactgaataatattcctttgtatggatcgaatacattttgtttattcatcagttggggtacatttgtgttgttctcattttttggctaagaatagtgccgcaatgaacattcttgtgcaattttttggtatgaacatgttttcagtcctcttgggtatgtatatacctatgaatataattgctgggtcatatgataactcaatgttcatcttttttacaaattgccaaattgtgttttacatagtaactatacctctgtgcgtgatgttccaatttctacctattcaggccatacttgttattttctgcttatttttattttttaaaattacatcccttctgatgggtatgaagtggtatcttgtggttttgattttcatttccctgatgtctaataatgttgagcattttttcatgcgcttattggccatttgtatatcttctttgtcaagtgtcttttcaggtcctatgttcactttaaaaattgggctgtgtatcttgttcttgttgaattatgagagttatgaattatgagagcgatctcggctcactgcaagctccgcctcccgggttcacaccattctcctgcctcagcctccccagtaactgggaccacaggcacctgccaccacgcccggctaattttttgtatttttagtagagagggggtttcatcatgttagcccggctaattttttgcatttttagtagagagggggtttcaccgtgttagccaggatggtctcgatctcctgacctcgtgatccacctgcctcggcctcccagagtgctgggattacaggcgtgagccaccgcgcccggccaaagttcccttatattcttttaaggatgaattgtgcacataaattgactatgtatactaggctgttgtaaacagggtaggaaggataatagaaagtctgggaaattctggagaatttcattttacttcttcgtagctgcacattcctttatctatttgaatgcccatagaattttttccttatcatttttggagttcagtggctttactaggataatgatcattcagaatcagtattgtttgtgacacattgtgcacgttgtagtttaggtgtttattttagacaagatttttttttgataaatatttctgtatactatttcttttctatttgttttcctcttttctttaggaacactgattatgtatattttatattgccctttcctgttactgatatcagtgtccttttctaatattgttttataatttttcaaaattgttatttttgtatttctagattttatctaccacgttcctaatttgagttatattttatttgttgaacttctggctatttggagatttatacataactttatgatattagtttatagtttaaatccattgtgatcagcacatatattgtatatgatttcagcctttttcattctacttagacttgcttttatgttcttgtagtatgccttggtgaatgtgtactctgctgttgttgggtggggtgtcctacaaatgtcagttaggccaagttgattgatagtactgtttttgtttttaattctttacttacggtctatttgttttatcaattcctgagagaggagtgttgaaatgttcaggttttggatttgtctattcctgttttcagttctgtattttaaaaaatgtatgtatttcggagatgtgtagtgcctacaaacttaattaaccatgttatcattatgaaaaaaatctctctatatccatggtaatagtctttgttccagagtttactttgtctaatgttaatgtgtaactcttttttgattagaattatgtggtgtttgttttgctcgttcgtttactccttcatgcccctatccccttaatttttaacctatctactttattatttaaagtggatatatatgggtctttttttttttaatataatcgaagaatctcttccttgaattggtatgcttagacgtttgagacttaatactatattttggggtttagttctagtatcttgctgtttgttttctagttgtcccatctattgtttgttttcttttttcttttcataactttatttagattcattccgtttcatcctctctattccattcttattccactctgtctacactattgcctttattagttttaccttttagttttatggctttagttgttctagggtttacagtttacatcttttacttatcacagctaccttcaaataatgttatactgtgtcatacattgtgtaagaacctccatttccctcttcctgtccttggctattgacattgtgcattctacttttacatatgtcataaactctgaactatgttgttatgatttttgctttaaacagttaattcttaatcttattagaagataatgtttctttcttcttcttttttttttaaaaaattcacccatatatttaccattcccattctcttcacatttctttgtgtagagccacaaatatttccatctggtatcacattcatttagcccgaagaattttctttaacattttttgtagtacagatatgctggtgaggaattcttcccagcgtttagtcataaaaaagctcttttgctaacatttttgaaagttttttttttcctgaattttggattctaggctgacagttttcctttttctttcagcatttcagtcatggtattctgttgtcttctgttctgcatgatttctgatgaggagtctgctttcattttgtagctttgtttctttacatgtgatgtgtttttctccttaacactagttttcagcaatttgattataatatgccttggtatgtttttaattctcttctgcttggggtttgctgaatttcttggatatttgggtttatagttttcttcaaattgcttgatagtgtcccacgtcccattaaagctttgttcagttattttagtctctctctctctttttttttttttttttttttttttgagacggagtctgtctctgtcgcccaggctggaatgcagtagcgcgatctcggctcactgcaatttctgcctcctgagtttaagcaattctcctgcctcaggctcctgagtagctaggattacaggcacatgccaccacgcccagctaatttttgtatttttgctagagacggggtttcaccatgttggtcaggctggtctcgaactcctgaccttgtgatccgcccgcctcggcctcccagagtgctgggattacaggtgtgagccaccgcgctgggcctattttagtgttttatctttcctggtcctcgatttcctgggaactcctcagagactagtcagctagtgggagaagagagggaagcatttgttcctacatttccatcttctgcatatatgattgcaaagtagtttgctggtgtctcatgctgcatggtggctttaggcaatgcaaatgaaagtgtacattgaattggtctccatagcagcggccagaatatgaggtagggtgatatacaagagaagttctgtactctccatgtgtggttacagttgggaaaatgacaaatggtggagggtttgtggggttaaggaaagagcaggttacatacagtatactatagtagcatcctgattttttttaatctatttttgttttattgttcttctattttatcttgcatgtttattaaccttcagtataaacttgttgctcacagacatattgaaatgttttcttactttgaggctttgttatttagaaaatttaattacataattcactttattcatagacaaaaccaaatgaataagggatcaacaaattagatattccagggcagaaattttaaaaataattttccatgttactatcaagtagagtcctgcatgtaatgtaaatacttcataaatacttctgagagaaagtattaggatagagggctgtggatcaggttgcctggatttaaattctaatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaatgaaataaattcttactcataatatttggttagtttggtaaacaatttttgtgtgtgtgtgtgaaaagcattaatctggcacccttaaggagttaattaactactaaaaatacaaatttctgctttcatatcactataagagatatcttcatcttatcactcagtttgcatgtaaacaaaaaattatagaagctttttaaagttgtttcagttcaaaataataatgttatgtttgtcagtaacacaaaagtagtttttaaaggttataatttaagtgtaattatgcttaaagtaacattatttttaatttatctgttaaaataaagcgacttttgttcttatatgatgcttttgaaggttttaatttcagacctgacatcataattagagttttcttatttggcctagccattaactaatgtaaaatacaggttgattatcccttatccaaagtgcttggtaccagagtgattcaaatttcagatttttttcagatttggaatgtttgcacatacataatgagatatactggagatgtgactcaagtctaaatatgaaattcatttacatttcatatacaccttatacacatagtctgaaggtaattttatacgatatttttaataattttgtgtgacttaatcacatgaggtcaggcgtggaattttctacttgtatcatgtcagtgcccaaagagttttgaattttgaagcatttcagattttgggttttcagattagggatgttcaagttgtagtagttttggtgctggcttttagcattatataaagaataacaagataaatgttgcagtaggctagaggttcttcactcggagcttatgaaaagacttagagttttctgaaccccctgaagtagtatgcaaattttagtgtgtatataaacacacacagacatacatatttgtatcctctttttgaattgaacttactgctcctgtctaactgaaactttgtaccctctgaacaggatcttcctgttacatacccacccccactccattccgcctacgtttggtaaccaccgttctactctaactaccattctactctctacttctatgagtttgacttttttagataccacatttaagtgagatcctgcagtacctggcttatttcacttagtataatgtcctccaggttcaactgtgttgtcttaaacgacagaatttccttctttatttaaggcagaatagtaatctattgcggatatatgccatattttctttatccattcatcccttgatggatacttatactgatttcatatcttggctattgtacagtgaacatggctgtgcagatatctctctaacatgatttcattttctttggacatatacccagaagtgggattgcttatatttttagatttttgaggagcttcaataccgttttccataatggttgtattaattttcttttttcttttttttgtgagatggagccttgctctgttgccaggctggagtgcagtggcgcgatctcggctcactgcaacctccgcctcccaggtacaagcaattctcctgcctcagcctcccgagtagctgggactacaggtgtgcaccaccacacccagctaattttttgtatttttagtagagacggagtttcaccatgttgactaggatggtctctatctcttgacctcatgatctgcctgcctcaacctcccaaagtgctgggattataggcgtgaaggttgtattaattttcattcccaccaatggtattctctttttctccacatccttgctaacacttatctttcatcattttgagaatggccattctaacaggtatgtggttatatctcattgtgaatttaatttacatttctctagtaattaatgatgttgagtatgttttcatatacttgttggccatttgtatgaaccatttatatgttggccgtttgcattgttcaggaacccgttggccatttgtcatcttttgagaaatgtctgttcaggtcctgtgcccattttaaaattgagttatttgttttcttattattgagttgagttccttagatattttggataacaactctttatcagagggatggtttgtaaatttttctcccagtttctgtgttcttccttcattctgttaattgtttcttttgccgtgcagaagtttttgtttgatgcagtcccatttttctgttattgctttcatttcctgtgcttttagggttatagtcaatgcccagaccaatgaagctttgtccataagtttcttctagtagatttacgtttcagatcttatatttaagtctttaatcccttctgaattggtttttcctcatggtgttagataaagattcaatctcattgttctgcatgtagatatccagtgttcccagcagcatttattgaagaatctgttctttccccattgtatattcttggcatcttcatcaaagatcaattgtccataaatgtgtgggtttattttggattctgtcttgttttgtaggttgatgtgtctgtcttcatgccagtaccatgctgttttgattgctatagcctgttagtataaagtcagatagtgtgatttcttcagctttattcttttttgtttaatattgcttttgttctttgaggtcttttattccatatgaatttaaggatttttttactgtttttgtgaaaaatgacattggaattttgataggggtcgcattgaatttgtatattgctttgggtaatatggacattttaacattaattctccaagttcattagcacagaacatctttccatttatttgtgtttttttttagtttcttttatcagtgttttatactttttagtatacagacctttcatatccttggttaactttatatccacatatttttgtttttgctgttataaatgggattgttttcctaaattttttttggatagttttagttttggacatgttaatgcataaaaatggtactgatttttacatgttgattttgtatcccacacctttactgaattcacttatcagttctaaaagtttttggatggagtctttaggggttttttttttttttttttgagttggagtctccatttgtcacccaagctggagtgcagtggtgtgatcttggctcactgcaacctccacctcctgggtttgtaactgagattataggcacgtcaccacacctgggtaagttttttgtattttagtagagacggggtttcaccatgttggtcaggctggtcttgaactccttacctcaagtaattcacccacctcgtcctcctaaaatactgggattacacgtgtgagccactatgcctggctgggatttttacgtataagatcatattgtcaacaagtagaggcaatttaacttcttttttttctattacaatgccttttctttcttcctcttgcttagtttttctgaataggacttccagtactgtgtggaaaagaagtagtgagaatgaacattcttgtcaggtccctcatctttaaagatttcagcatttcactcttccatatgatgttagccatgggcttgttctgcatgtcctttattgtgtttaggtacattccttctatacctaatctattagtagttttgatcacgagaggctgttgaattttgtcaaatgccttttctgcatctattgagatgatgatatgacttttgtcctttattttgttaatgtggtgtatcatatttattgacttgtatttgttgaaccatccttgcatcccaaggataaataccactgtatcatggcaaaagattattttaatgtgttgttgaatttcatttaatattttgttgagaatttttacatctatgttcaccagagatattggtctgtaagtttgttttcttgtagtgcccttgtctggctttggtatgaggataatgctagccttctaaaatgagtttgaaagtattctctcttcagatttttggaagagtttgagaagtgatcaatattagttgttctggtagaattcatccagtccagaacttttctttgatggggactttttgttactgattcactcttcttactcattattggtctactcgtattttccattctttcatgattgagtcttgataggttaaatgtgtctgggaatttattaatttcttttagcttatccaatccattggtgtagcattgttcacagtagtcgattctgatgagtctctatatttctgttgtttctatcagctgtaatctctccacttttatttttaattttatttatttgagcatgctcctttttcttagtctattgaagggtttatcttgtcaaaaaaccaaatcttatacttcagctgcatttgataggttgtgtattttgtgtttccattttcatttgtctcaagatacattttgatttcatcttttacctgttggtaatttaggaacatgttgtttaattttcacatatttgtggttttccccaagatttctttttggggtggtgaaaatattctgtaattatatagttgtgatggattcacaaccttgcgttaggtaatcaccattaatttgaatggcaaaaaacacgattacatttgcaccaacctaatatatatggtaaaatccacttaattacacactttgaaaaaatgagggttatgttatatgaattttatcttcaaaaaacgttttaatttgatgattatttaagtagactgtgttattgccaatcttgtggccgttattttatatggatttactattcaaaatcttacctttttgatgccagcccatctataagttaactctacagtaacatcttccttggcattagcacttatcactgtgtgaaactgtctaattcatttatttgtttatttgctaaatttctatttcctgtgatattttcttcagagtattttttggtttattgtctcacaatattaatgttttttttaaattttaaacttttatttttattaattggcttagatagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgggattacaggcatgagccaccacacccggcccagaaccataatttttaaagtctacgtttgactgtacaccacctttcatcataatctcatgcctctagcctaccctcctacttgctgtcttaattcatattattgatagttacctaccaacaatatccagttttttcctgtgtatggctttttcttctatctggaacctaattctgtttgattacattctcctacagtttcctctcttctttgagcactagctttattttaacattagtctttttcctttaatttaacactatgctaattacagtctacttgtacttcagaaaaattacgttctcttacacattcctacctttttttcaggtattctcccctcttccatgtcagaaatattttattctttcttttcctttcccttccttctgttaagtttttaaaaacagttttatttatataaaatttttgtaccacactatttattccttttcaggtatgcagtttagtggcttttaatatattcacagagttgtatatccattaccataatcaattttagaacgtttccagcatccctgaatgaatccttgcattccctagctatcactcctggagcctcccattttcccagcaataggcaaatactaatctactttttgtctgtatggatgtgcctattgtggatgcttcatataaatgaattacataaaatgcagttctttgtgactgcatattagtgcatttttccacttagcatactatttcaaagtttgcccatattatagcatatgtcggtgctcattcctttttattgccaaatagtattccattttatccatataccatattttgttaattcattcatcagttgatggacctttgcattgtttctacttctgaatattgtgaataatgttgctttgaatattcaagtacaggtttttttttgtgaatgtatgcttttatttcttttgtgtatatatacctataaatataattgctgggtcatatggtaattttatttgtaaccttttgaggagctgccagactgttttccaaaccagctgtaccattgtactttccattggcaatgtgtgatggttctaatctctccacatcctcctcatattgttatctgtcttttgtgttccagccatcattgtaggtgtgaagtggcatcattatgattttcattttcatttccctcatggctaatgatattgagtatctttttgtgtatttattagctatttctatctcttctatggagaaattattcaaatcctttgcttattttaagatctgcctctttttcttttaaattgtgagatttctttatatattttagataaaagtttcttatcagatatgatttgcaaatgtttcctgtaattttgtgggttgtctttttacttttctgatggtgaccttttgtctaatttttttcattaccctcaagtacatcttctttacattggaccttgttatcatttagaaatggtttatccctttgatactgatattgattcttggtcatcatcattacttttagtccttttatttttttcattttttttaatatcacagaatccttcttggtcttattctttagcttcattcccattggccaacattttctatgacactataattttagactatttttctttcctttctctgtttatctttgttttctccatgcctgttctgtcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgttattttggttgcaaggatgatagagtgaaggtaaattcaaagagtaagccaagaaagaaaataggataatgaatagatattgatgagaaaagaataaaattcaagacattggttaggtctggttgtttgaacttagtgaagaaagtgtacatttgtgccctgttaatgtagctatttacaagaggcctcactaggctcacagaaatgtatgatgaataaatattttcagttctacagattcccaaggggagggagtcaatagacctgtgaatggatgtgacaatgcaatgggatatctagaagaaatgggtaaattcctggacacagcctcacaaaactaagccagaaagaagtcaaatccatgaatagacccaataacaatttctgaaattaaggcagtaattaacagcctaccaatcaaaaaaagcccaggaccagatggattcacagctgaattctaccagaggtacaaagaggagctggtaccattccttctgaaactattccaaacaacagaaaaagagggactcctccctatctcattttatgaggccagcatcatcctgataccaaaacctggcagagacacaacaaaaaaaaatgggcgtggtggctcatgcctgtaatcccagcactttgggaggctgaggcaggtggatcacgaggtcaggagatcgagaccatcctggctaacacggtgaaaccctgtctctactaaaaaaaaaatacaaaaaattaactgggcgtggtggtgggcacctgtagtcccagttactctggacgctgaggcaggagaatggcgcgaacccaggaggtggagcttgcagtggagcttgcagcttggagccgagatcacgccactgcactccagcctgggcgacggagcgagactgtctcaaaaaaaaaaaaaaaaggaaaatttcaggctgatatccctgatgaacatccatgtgaaaatcctcaataaaatactggcaaactgaatccagcagcacatcaaaaagcttatccacgacgatcaagtcggcttcatccctgggatgtaaggctggctcaacataatgcaagtcaataaacataatccatcacataaacagaaccattgacaaaaaccacgtgattatctcaatagatgcagaaaaggccttcaataaaattcaactccccttcatctaaaaactctcaataaactaggtattgatggaacgtatctcaaaataataagagttatttatggcaaactcacagccagtatcatactgaacaggcaaaagctggaagcattccctttgaaaactggcacaagacaagtatgccctctcttagcactcctattcaacatagtattggaagttctggccaggataatcaggcaagaataagaaataaagggtattcaaacaggaagagaggaagtcagattgtctctctttgcagatgacatgattgtatatttagaaaaccccatcgtctcagcccaaaatctccttaagctgataagcaacttcagcaaagtctcaggatacaaaatcaatgtggaaaaatcacaagcattcctatacaccaataatagacaaacagccaaatcatgagcaaactcccattcacaatttttacaaagagaataaaatacctaggaatccaacttacaagggatgtgaaggacctcttcaaggagaactatgaaccactgctcagggaaataagagagggcacatacaaatggaaaaacattccatgctcatggataggaagaatcaatatcgtgaaaatggccatactgcccaaaataatttatagattcagtatatccccatcaagctaccattgactttctcaacagaattggcaaaaactactttaaatttcatatagaaccaaaaaagggcctgtatagccaagacaatcctaaacaaaaggaccaaaactggaggcatcatggtacctgactttcaaatatgctacaaggttactgtaaccaaaacagcatggtattggtaccaaaacagatatatagaacaatggaacagaacagaggcctcagaaataacaccacacatctacaaccatctgatctttgacaaacccgacaaaaactagcaatggggaaaggattctctgcttaataaatggttttgggaaaactggctagccttatgcagaaaactgaaactggatccattccttacatcttatacaaaaattaactcaagatggattaaagacttaaatgtaagacctaaaaccacaaaaaccctagaagaaaacctaggcaataccattcaggacataggcacaggcaaagactttgtgacttaaacaccaaaaggaatggcaacaaaagccaaaattgacaaatggaatctcatcaaacgaaagagcttctgcacagccaaagaaactctcatcagcgtgaacaggcaatctacagaatgggagaaaatttttgtaatctgtttatttgacaaaggtctaatattcagaatctacaaggaacttaaacacatttacaagaaaaaaaaaccctatgaaaaagtgtgcaaaagatatgaacaaacatttctcaaaagaagacatttatgtggccaagaaacatatgaaaaaaagctcatcatcactagtcattagacaaatgcaaataaaaaccacagtgagataccatcttataccagttagaatggtgatcattaaaaagtcaggaaacaacagatgctggagaggatgtggagaaatagaaatgcttttacactgttggtgggagtctaaattagttcaaccattgtggaagatagtgtggcaattcctcaaggatctagaaccagaaataccatttgacccagccatcccattactgggtatatacccaaaggattataaatcattctacataaagacacatgcatttttatgtttattgcagcactattcggaatagcaaagacttggaaccaacccaaatgtccatcagtgatagactggataaagaaaatgtggcacatatacaccatggaatactatgcagccataaaaattgatgagttcatggtttttgcagggagatagatggagctagaaaccatcattctcagcaaactaacacatgaacagaaaaccaaacaccacgtgttctcactcataagttggagctgaacaatggaaacacatggacacagggaggggaacatcacacactggggcctgttgtggggtagggggataggggagggatagcattagaagaaatatctaatgtagatgacgggttgatgggtggctcgaaccaccatggtacgtgtatacctttgtaacaaacctgcatgttctacacatgtatcccagaacttaaagtataataataataaaaacacgaaacttatactttcatttacttttcacatactttacagctgtctgcttagcatttttcatctagtgagctgtataatgtaaggactggataccattaaagttacttggatagactgagttggctcacctattttagattgatatgtctcatttattaatttcattggcttcttaccaggaatattgttgttggcaggttatatatccttttttacagatgggaacatttatgcttagaacaatttagtgtttttcttaaatatcatcccgcagctattcactgactaagtcattttttgaagccaggcctttggaattttctgctaccattatgtctgcaataccaaactatctctggtaaatgagatcagaaatagagtaaagtgtgttacttcattagaaaatattaatgaaattatagcaaatattggaaatttaattaaaataataaattataaaggataaagcagagattaaaatttgagctaaatatgtattattaatcaggttattgaatatatatttttgttattcgtgtttctgatggctcttaaatcatagaaattctaaccctgtctttttgcgagaagattaaatataaagtcacacatggctttggttttgctctggaaaacaaggacttgctaccacttttccttgttcagaagttcattattttgttgacagtgtagtttcattaatctggtatttgcagggaaataacttacagactttaaaatctgtgctaaaggtgatcaaatggacattcgaatccctcatttaagttatgtcttaatgttaaaataaaaatctactttccagaaagtaactgttaaagtattttatgcaacatttcatgtgggataccttaatggttgaataataaattttacctcataaaaatgaaattcaataatacagtagctttctcagcgcagtagcatctggtctattctcatgagagccaatattttccaactcattaggatcatgtcgttctgtatgtcgtcaacattgacttagccaagcaacctttacttacataactgccaaactattaaataggtctcttgtggagtgaagtcaaatattcctcttactttacttctgccttagaagaggggaagaaaatgtacatactgtaacatttaaacatctggtctaaaaccacatcactgtaactgaataaagttatggaggtattcttcccaggtgtgcatataaaaaggattttggagttgttgaatagttctttaatcacttaggaaaaagattgaggtatattgatatgatttttctattcctctgttttcaaactacttcccccaacaccatcatgtctgctaaatacttctaatgtgttctaagatatatatttttgagatgttataaaattttcttgccagatacaggcattggctatacatttattcttgcgtaaaaaaaaatgaattgagttagatttgtattgagaactaccaattagacctcttgatatttaaattggagtaaaaagacattaatttttgtgaatcttgtgagttttaaggtgtccctatatgcacttttaataatatgaatatttattgaatttaaagtttccattttactacagcttatgtccaggtattgagagctcatttatagaatatgtggtcattattaagaagtgagtaattaatataggtttaacccatttatgctggaggttgcaattttgtgtgtgtgtgtgaaaaatcagatcttggcaatgactttgcacagtaggatataaataactcccacaagcttagcattctaataatgcaacactaggaataaaggggttaaagacacacttagaatgttaagttatgcctgacttaattttgttcctctattctgtctcagacattttgataatgtttgtaaatttttttctgatgatacttcatggcacaggaatgggaattttaggtgtcctttagtgaaagaaaatatataaagtgtaagtgtacagagtagatttgagaaaaatgcaattctttgaattattatttaagtatattttattggatatttgaaaagtaggcaatatgaatttagtgtgatttttcagtcttacagaaagtcttttatgaacatcataaaaatgtgtcaataaattactgttgataataaaatattaatagataaatgagttagatttctgcagaaaagatactttttttgccttatgtatttttttgctgtttatttgcctatgtattctttgctcatgtttatgtcttctatttgttcacaacctaaaatgtatttcttctggttgtattcacttatcagtcattttgaaaatatgtagtttgcaatctgttcagttctgggagcagatagctaacaagaaatagacatgattttagtaatgaatgtagaatcttctgtgtcacctattacaagatcaagtatggctttaaaaatggacaagagttaattacatacagtgaagaaagggactcttatttgtgagggctgtttacaaagtaccacaaactaggtgacttaaaacagcaaatttatttgttgaagccttgggctgcttaaaatcatgttggaaggcaaagcagtagctggcgtgtcacatcgccagagttggagcaaaagagagagttgggaggaggtgtcatgcactttaaaacaacatcttctgagaactcactatcacgcagcaccaagccatgagggatccatcctcatgacccaaacacctcctaccaggccccatctccatcactggggattacatttcagcatgtgatttgaggggatgacaaatatccaacccatatcacatatcattaagacttcttttctttctttttatttcctttttttattgattctacttggaggaaaattgtaatatttcataatttaaaatgaaattttggttgcaaaattccattaatcccaagtttctgattctatctttttatagtcacctttttaaatgaagtgtatatctcatatgataaacatcttcatattatatgtaagattaaatactatgttgattttactagatttttgtttgctctttaccacagagatttatttgaaatataaatattttgcataaagtgaatacttattttaattaatgattcatggaacatataggtcaaatcattgcaacaaatgaaatcatgataaaagtcttattatcatagattgacttcctaattcttaattttaaaacagtcctttactttcacaggaaagccaagtgacaatagtgaagtaattttgtaagttctttgtagtccatattttcattaatctcttgtacattctttgaagtagaaaatctgaacaatattttacaggtttaaaagctgttgaagatatttttacaaggctactgagtagtaaaaaataacagaatgagaagttgggttctagttttcagagaactacttgtgtttattttttaagaaataatgcgactgggcagggtggctcatgcctgtaatcccagcactttgggaggccgaggtgggcagatcacaaggttgagagatcgagaccatcctggccaacatgctaaaaccccatctctactaaaaatacaaaaattagctgagtgtggtgacatgtgcctgtagtcccagctacttgggaggctgaggcaggagaaccactttaacacgggaggcagaggttgcagtgagccaagatagtgccactgcactccatccagcctggtgacagactgaggctccatctcaaaaaaaaaacaaaacaaaaaacaaaaccgaaataatgctgtaatatactacacaattccaaatttttacttattatggcaaatagaatgttagagtataatttatattggactttgttggatttattaatgtgaatccttgaaaaatttcctactgattttaatataggtaagaccaagatctgtaaatattatttttattctgttttagtaggtaagtatatagcttctttacagtagatggacttattttttcactactattatgaattattttaataacaattttttttttttttttactttgtagagattgggtcttgctatgttgcccaggttgatcttgaactcctggcctcaaatgatcctcccacctcaacctcctgaagtgccgggattggaggcccaagccactgtgcctggccctttataaattatgttataatttcatgtaatacataattgtatagtcaaaatggctcacatattaaatattctttatacaaggaagtctcaaagagaaattacatttgaaatagtttattctaaaaagttttcaaatacttcagttacagaacttaaagtttataatgtatactaaatgttaatatttggttcgtactcaaaattttttttttaaggacaagagatgtaggttctgtgggtctaaaaataatacccatatgtgtcactatatattagttcttataataagcaattaaaaatgtataaccatatacataattactcatttttctttgatgatagtttaaataattaagaatgtgctaaatatattctgaagatgagcacaatttcaagtaataaattatgtagggctggttctaggtttaagtgaataaggagaagatagctgctgagtgctggaccagaatcccattttatttatttacttctacctgtattatgctctgggaatcagcatttcctacactataaaggaaatttccaaggcagagcagctaattttaccctggatattctcagcacctcatttctaatccttgtggcatacagttcttttattgacccctatattctcaaacacatctcccattgagctatgttcctttggggtgtacttctgtggcactctgcagtatcctcagtatctttctattatggccattggattccactggatcggatatcgggtcatttttgtagtgtttgtatgtgaatacatttatagtctcacatttggtgccattgtgttagacatagaacattctcgaaactatatttgaaagctgaatgtctggaagttgaacaataaacttacattataaggtcttgaaaaatatatatatatatatttttgagacagagttttatttccatctctcaggctggagtgcagtggtgcaatcttggctcactgcaacttcagcctcctgggctcaaaagatactcctaccttagcctcccaagtagctgggaccacaagtgcccaccagcatggccagctaattttttgtagagatggagttttgccatgttgcccaagctggtctccaactcctgagctcaagcaatccacctgcctcagcctcccaaagttctggtattaaggtgtgagtcactgtgcctggccaggtcttaaaaatatttaatgtttaactgtctttcctattggtatggcgttcttgggctaggaaattaaggatatatgtgagaactatctcaggtgacaaatgactgagacgcaggaggtggtgcttagttctgggagcctgccagccagacatcctcacttcccacaagcccattggatttttttcccttactctcatccttgttactaccatgattgtaagatgaagccgtccctaaatgtgaaattttcttataggaatgagaggctgaatgaagtaggcaaaaggcatctttgttttcttttgccatgagaggacaaggtaagggaggcttctggcagtcactctacttacacttgaggacaagcctgaagctgtctaccttttacttcttttaactcacacacacctctggctgaattcttgccgacttcttgcatatcttctaccaggcttccacccggtaatagtaagtacagcaacaaaagtggaggaaggggagaggacttggtttgctctctgccctgaaagacaatcatcttttatattaggaagctccaggcccctggcaggtcaggatttccaaggatccttcttggtagatttagacaagctagattttggaaaggagagttgttaggtatagctgtggttcagctggcagttaaaacttttgttctgttagagcctgttactactggaaaccccgtttctactaaaaatacaaaaattagctggacgtggtggtgtgtgcctgtagtcccagctaatcaggaggctgaggcaggagaatcacttgaatctgggaggcggtggttgcagtgagccaagatcgcgccactgcactccagcctggcgacagagagagaaaaaaattacttatgctttctgtaatagatgttgttggttcagtacttttgttctttcagtagtaccacgagtttcttttggagaactcttttgccaatcaaagcaattgtgcaattttatttttttaattttaatttttttttgagacagagtcttactctgtcacccaaactggagtacagtggtgtgatctcggctcactgcaacatctgcctcccgggttcatgcgattctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaatcattgtgattaatatatcagcttagtttgacagatatttcttacctactaagtgctagacttggaccctgttttcaaagctctttaattctagctgggtaatatggcgtgtgttttttgtacacatcactctttattgtagttacttttgtactgagattttctgacaaaatctaatgtgctgtaatagttcatattgttaatacacatcttaagaagtttccatttgttattactacctaattctaataaaaattttattgcaaatattcattgaaaataaatataataattagttttaataatcaaatataacattttttccagatttccatgtcaaaaattatagatagtcctctgacaaaaattgggttaatattatttgtaacttggaaaacataatttttcagtaaaatggctaataattttttccctatctgacttgacctgctttttagatccttttatataagaagtagtaattcttttaaagtaaatatttctctaagagcctgctttgatagtccatacatacttttctcttctctgtagctagagcccctgtattttcagctatgccccagggttcaggactaatcctgtctatgaacctctgttggtataacttttgcacatttattcaatgttcatgtgattcaggagcatgtcctcaactttgcagtgtgttgccttgactgtgggcttagctttatgtattgaaagctcctacttgagctgactaagctttcatcttgaactgccatttcagttgctggatgcctttttttttttttttggctgggccacattccctgtttggtatcctagcccgtcagaggctaccgtcatgaatttccctttctagactcccataagttctgcaggcttttccttaattccaactctctggatgtggtactcccccataagtattaccagaccaatttggagacatctacttgcttactacccatttaattttttaaaaagttattattcattatattatatttgcctgctgggacacctactgtattgtttcttattggacaggtattagacctgaccacttgtctcaacttttgccttctatccaattcttgagatcaggatttggcaaataatctggctcactctttgcttttataaataaaattttattggaacacaatcatgctcactcctttaattattgtctgtgactacatttatcctacaatggtagggttgagtagttgccacaaacatattgtccacaaatttgaaaacatttatcttgccctttaccagaaaaaatttatccactgcataaagtatagcttatagccttgtacttttcatatggtgcctatttcaaacattgtactttttatctgtagagaacttaataaaaattaacatacttatcagatttttcatgtaattttaaaatttacttagtcaaatattgacagaagaagtcctggaatttaaactttattgctaatttttcttcattttttttaccagcattttgttaacgtgtctcatccacaatgtgtataggtttaactgattatattaattgatactttttacctatgtttaatcatgtacccatagtaccaaataccaggtgttgtccaatttattttctcaatactttaacaacatattcatttctctccatctttacttctgtcacactaaggcaattccataatttctttttccatccaatctattgtctattttgtaccagagtgagctttgaaaaactcagatgtgacaagtactaccagcccttcactgacttcatattaattgtaggataaaaacttaaatatggacctattccccagtaacctctgagcttctcaaaagaactatgcttctttctattttggagtttttttcaatatactccatatttctgcaatgcccatgtctctctatttaatctatttatatcaacttatcctttggagcccaccttaaatgtcagttcctcagaggagccttctttaagtagaaaataggttcctcaaaggcaggttgcatgtctgatttttttccctgctgtatcctcagtaactaatgtttactttgcagaatgtctaaagatgataagtgttgtatgtctgcttttttggtgaatgttcaaaatgtaaatagtttacaaattctactaattcttaaagatcacctcttattttgcctgcctgacaccatgtgttgtatagggtgtacaaactaggagattagtctctgttagtgagcaaagtaaatcacttacaattagattataggaattaattgttaagaaaatactgtgatttaagttatgtgtgaaaaattgttaaaatagaatttctgtatgcattcttatctgtgtctaaagtccttaagaccatccttactttagagagcatctagaaggacttacaggactcaagatgtagttgtacgcattactaagatttattatagcaatgtagtaaggatacatacttgggtcataagaggaaaagacataggttgagtctggagaaactcatgcatgtgattccttttgccccctgcctcctgtgaaggcacaggtatgcttgagtattgagtatactcctttttccaccaacaaaaaaatacactaatatgagcattgtttgaagcccattcagtgcccaaggttttcgttgggggctggtcatataaacaacctctgccttgcaagtaccaaaatcctggactcctagaaggaaagcggatgttcagtataagcttttctttttgtacagaaggctccacatagcaaaccactcttatcttagaggatgcggggaaggcaacttcccagacttcaccagtcaaggtccagctttccaagcaggctttccaaaggataacagtcttaggcttgctatattgtcttttttgtagtgttcttaaaataatgttttctaatgttatttgctttttattctagtcacagaggtacttctagctagatacattcctacattgaattaaattgaagttcttttagtaactaagaaaggggtatgagtagtaggtaggcagctactaatcctattatgctaagatttttttcaagtctcccttgggaaaaatttgaatgcctaatggggcacatcatgtgctacaattgcttttgttcactatgcttaagccacatcgatctcttttctggactttaaatacaacaaactttcttctgctgcagggcttttactgtgttattcacttttcctgttaggtcctttccatttttacttggcttataaccacttatttttcatgtctcaatttaaacttcatctgtgatacctcactaccctctcctcccatgtctcttaggttagctactcccagtattacctttcaattggattataattgtttactgtcttttcttttctagaggaacatattctcatcctagcatatcacatgaatgaatgaatgaatgaatgaatgaatgtaaaatttgggtggaggagaataggggagtgctagaggaaaaggagggaaagagattaaaatttgtatgacatttttgagaattatatatttaataattcaaatttaccctatctagtatcgtagccaccagtcacatgtagctattggatacttacatgtggctaatctgaattgagaaataagtgtaaaatacttactgggttcaaatacttttaaaaaaagaatgtaaagtatcttaatttcattacattttaaagtcattaaattgtttttggatatattgaataagtaaaaatgttaatattgatttcacctgtttttacttttttaatgtggttagtacaagattttaagtgacattttctaatagacagtacttgctcggaaagtgaggcgttgatgttttaccttagtgtgtggtcctacaaatttaaactttaggctattatcaagaagaaagtatctaaaaaatggcacattagcttttctttcctattgtactggtactagtttggggcaaaaaatgttgtgttttctgtttactcttttcattattttctgtttactcattttctgtttactcttttttcattatgtaagtaaatgatcaaaacaactgtaacagatcatgttcatgtttattccctctaataacatttataatagtaacaataattgctaacacataagtgattatcgtgtgcctggcactgttctaagggcttcatatatactaacacatttaatccttagaatagccctgttgttagataccattgtcattcctttttaacagatgaggaaactggggcgcagaggcagtaacacggtcaaggacacagcatgtttgagtcttaattccgctacctgataatgatagtacctaagaatgtgatttagagaattaaatgtgattcagagataatttactttcagagctctggctatatgacttactacatgtgacttttcacatagtaggcattcagtagatatttttttatttgaagaacactgagaaggtgtagtttctagtttatgctttccagctatattatatatgggtatttttgtgtatttcatttttggtaatatagttttgaatctcaaaatacaaaagagccgtgcgtatatgaacctcactaagcctcattataaaagacacatgagttgattccttttcttggcaaatccttccaggataaaaatagagctgtcactagaacaaaaaaagtatggaaaaagaaagctactagttttggtagtgactagggttgctttgggccatatctggttgtgccagtttgtttacttattatctatggtgacttttgcacaatgccagacttgagtacttgcaatagagatttcatggctcacaaagattttggccctttgcataaaacatttgccagtttctgactcatgaacatatcaatccaataaaagaatctagtgctggaccacaattaaattagaatctcctaggtttttcctgggctgctcccttaaaggtatgccagttagactgtcttgagattgtttttaggggaaagttggattttgattatatccaaatatggtcagagtggaatcctgagcgttcacaataagtgtatcccaggagttggcaaactgcagcttgcagtggcctggtcttgtattgcttacaagctaagaatgtttatttacattattagaggattgaaaaaagaggaggaagaagaagaaatgtgagtccatatgtagcacacaaagtctaaaatatttactatctggccctttatagaagaagtttgctgatccttggtctgcataatctgcactgttttttctgatcactaccctggtagtagccaaaaggagatgattcctttgtgatgacagatgcatttgttgacatttatttacagtcttagcactgtagactaagagagggtaagggaggtggagttttgtgtttcagttgatttataaggatgcagttttggtgtttgataatatttgatgcctctggattagatagcgaacatggaatatccatcaaatattgttgattgtttagctgttgtgtgctctttatgataaaagggcattgtcaaagtgccattgtcgtctggcacatggtcttgaaaactgaaaatatgtaatagcttaattgttatggccacagtggtgcagagggagtcagctgatcagaatgaatgggaggtgggtgggaatgaaataagtttgacaagagtagtctggaaagggatggagtggtaatgcctcatgcaatgtggcctttcttgtgatgtaaactggttgagttttggtggtcacaagtctgccatacagtggtaatctctgcatcagaaacagtcgtttgctttttgcccagtctatgatggtgaatatgttgctatgtgatacagtgatggatccaggcagcaattgtgacaatctgggtggtgcaggtttgatcaacaccttgattccagttgacctcatcctggaatgggcccctactgtggtcatcagcatgagtgacccagattatctgatcagcaatgattttttttctatagtttgtggcctctaagctttagtctttaaatctgccactctggttttccaagtggcagcgtaaacaggtaggccattggcaataacgatcagtcatttataacaagattcctcaagggaaataattgccagaattatgagaatggccttgaattttgcctactgagttatgcccactgaatagctggagctaagataaaacagcagcagtagcacgatgtataccattgggtttcagtttagttgaatgatcagtgaatcagactctgacattttggggaatttcatgtatcaaaggccccattaggcctgcagcttggcttcaagtggcaaaatgagggttaaagtttctccccaagggatgtgtcttgctatgttttgtgcttctataacagaatactacaggcaggataatttataatgaatggagatttattggatcatagttctggaggctgagaggtcaaatattgagatgctagcatctggcaagagccttcttgcagcctcctcacatggcacaaaggcaaagagagtgagtgagtgtgtgtgcacgcacactggtgaggggggctagtccgcttctgtgataacaagcctactctcgctataatggccttagttcatccatgagggcagagtcctcatgacctaaacatctcttaaaaatcccaccttccaatactgtcacaatggcaattaaatttcaatatgagttttggaggggacaaacattcaaaccatagcaggatggctgccactttttcatgtaaattcaaaagcttctgggtgccaagcctggtatgttcttgaatatgctgttttcatttgaccaggggcagctaccttactcagatcgagccagttgtaatgtctctctataagtttaaagtccataaaactggtgttgggcaaatcagaatttttttctgagagttttgaacttggaaccagagaaaaatgaggcttgtttttagtgacaaaaaagtgtaagaattggtagttgtcattgtttgtttcctgccatgatgagaaattaggtctacagagagcttaaagtcatctgaagtgacaaagagacagagttttggagtcatttgagactctgcttccaatagtttctgaggccttgtctttcccttatcttcactgggttttaccaataaatctcagcttttgtttaggctagtttaaattggctttctgtcactgattaaaatatgagtcctagcaaatacatattactctcttaggccaagtataattactgatggtttggcatgttaatttaagacatattaatttgtatttcacctagacccatttctgtttgtttgtgttgatgtcatggaagaaggaatgaaaactgtatgcacattaaactagatgtcatttccaaatttgtcagagttgttgttaaacatatgaagtgattttctctaagacacagaagaagcataaaacgttaaagtatactttggattaaaggtaataaaattagaaacaaagatttgattggcacaagcaagaaaagttatggagttttgggttatattggactcctagggaatatgaatctgtactttgaacatgacttagtacattggtgagagagctaacatgagtttggattgattctacatcagaagattcaccaggaagaactgagaaattcttcttagttttattcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttcgtttcagaattttgagcagtactgttgacattagaaaagatttaaaaatacctaacaggtttccaataagctatttgaagaggaagaaaaatgaaaaggagagaaatgttaatttttttaaaagagagaggctttaataactattttcttatgaatatatctttgaagtttattctgttacacagaaaaaaacatacatctaaatgactattgcttttttaaattcttttagctaatacttttcagtcgcggacacaccgtgttctcagagttttaaaacttctttgaaattttttttggtggccaattttgcagacacacaaggaaatcagtacctcagctatttattcaggagtggagtctcactctgtcacccaagctagagtacaggggcacaaccatcatagctgactgcaaacttgaactcctgggctcaggccatgctcctgccccagcctccccagcagctgatactacagctgtgcaccgccatgcccagccagtacctcagcttcatatacatactttcttttcttttagagactcagaggcagacatagaaacaaaatgcaattttcagtatttatccagaactataccttttgttagaatataaagatttgttgggatccagtgttacttatctactgctcttggctctgaatggtatttatttatttcaaatattcagactcacccctcaaataatcaagatttggcatcactgggacaattaagaaggatgacctgtaggccgtaaatgtagttgtgaatgaagagtaccaaatatgtttttatcagtgaaacactgatttgcttagcttatgaatacttagaaagacaacacattttagtctgtctaatccactagcatagtcaggaccttatggtttaaattctagccccatgtaacttccttcccagttcacccccaatattggcatttactaactggtagtatcttaggcatcttacttagattcttgaaatttacaatttcttcattgtaaaatatggttaatactacatttttcatgttttggttgtgataaattgcattaatcacagtgcctagcttggtaattggtggctactgttattaattatagtaatagcagtgatcgaatttctcttggattatttcatgattttatgaagggtaacagggttttctaattctgtaaaagaaaggaatgagttaaaactagaaggaatttaggtggattaaaagaaaaaccagtggattttaaaaactcgaacaggatgacaattattcatcgtatgacattgtattatttgttttctaacatgtttcctttgaatggaccgtatgggtgctttgttaacatatacctcaattttttcatgaggcaaatagttgttaatgtctaatacaaaagatggccattacatattataaagtgctcattattggtgtatatatcacctttgatataggagattattttattttatatttttgagatagagtcttactctgccgcccaggcttgagtgcagtggcatgatctcggcttacagcaacctccgcctcctgggttcaagtgattctcctgcctcagcctcctgagtagctgggattacaggtgcacaccaccatgcccagctaatttctatattttcagtagagacggggtttcaccaggctggggttgaactcctgacctcaagtgatccgcctgtcttggcctcccaaagtgctgggattacaggtgtgagccactgtacccagcctgatataggagacgattttaattagtatgtgggaaactttaattttagaaattatttattttactgtgtattaggaaaaatatatcccacatatttatacacatgatttcaaatattactgcttaagataatagtggaataaaagtttgcttataaaataaatttattataatctaaatatagtaaaatgagtaaatttaaagaaaaaatattaatagtattgttaataattattgagtggttattatatatgacacactcttgtacatacttgctatctattgtgtcatttagtcctcacagcagtttagagaggtaggtactatcattatttccattgtacaaatgagaatacgagacattagcgaacagagaagtaaacattcttgcccttagttatgaatctagtaagtggcagagctggaatatcaatccatgtactctgacagtgtctgacctcttagcccctatgtaataactgctgcttcttcaataaataatagtacaaaggatatatggatagggtagtaataaagttggtatacaaatacatgaagtttgtacaaactgctctagataatgaaatatttctaatctacaaagaacgtattttcatatgtgtataaaattgaatagagatgcattcaaagaatgtattaagattattctaaatattaaagggaacattattgtcattcacataatgaaataatactttatttaaaaaaacaaagtatggcgaagtatagtaagtttttttcaccacttctgcacctgcttctgtgaaaaggaaatattcatagtttataaggagtgaaagttggttttttaggtcattcacaactgcattccaaactgtttgatattttagcttcaggatttaacatcctaacaaaagtcatgtgacatcagcagtgaggtgcactgagagctctctcaggaatactcttaatagaaaggaagactttaggtctgtgaggttgtgcgggcttgaatgtgatttttatttgatatatgagctgtgacataactgttgcatgactgagatgtgcttgtaagtgctgtactatgcagatgggttttttttctgaaacaaagccaaaaataaaatcttgaatgtgttcatgtagtgggaaaagaatacttcatagaaacatatggaaacatttctaagtttttttcattatatgaaccttttactttctaagcatttttatgattgttcaagttaacatgtcatttacctcatattttccaagtttagtgagacatgggaaatcttatagtactctgatgtttggaaacaaccagataatttttaggaatgcacattttaggattaggtgaaatgattattagaaaattaggattgaataatgggtttatttttcattacattattaatcataagactatagctaattaattatattaatctgatgggatttgatgaggagatgtattgagtggtttctttttactcacttttaaattaaagcataggacaacattaaaggaaatcataaaagtaaaaagatacaagtatagcatgactgtttttaattctccacattcccttccaactcatgtcttcgtatatacatttttacatgttttttatttattatatgtttaccattttatgttatgctcttcttttcataacattatgttttaaaatttctctttggtggtcacgtaccactctgattgtctctctcattgtgggaagcatacaaatagaaaattttcttagattcaaagttcctcccaaggtctcattttatcttcctcttttctgtcacagagaaatgacttagaattatgtacatgttgcctctccagttagctttgatgctgagtccggtgtatattttgtagttctaacttcctgactctgtatttgacatacgtagaactctcttctgatttgtgggctcttctcctttgtctttttatcgttgatcttaagagaatacactgagtaatctctttctcctgtgttgcttcagctacaacccatacactgacaactgcttcatttaatgctgtagcccagaacatcttcctgaaactgtgacatttatttgaatatgccaaggtatctaaaactcactatattcagaaggaaatttaactcttcttttcttttcttttttttttgttttttgagatggagtttccctctgtcgcccaggctggagtgcagtggcgcgatctcagctcactgcaaggttcgcctcccgggttcacgccattctgcctcagcctcccgagtagctgggactagaggcacccaccaccacgcccggctaatgttttgtacttttagtagagatggggtttcaccgtgttagccaggatggtcttgatcttctgacctcgtgatccatccatcttggcctaactgttattttctaatcagagctaatggtatcacaattcaccccttgttttatgtaaaacacctaggaattctctttaacttaaattttctcttgtctgcatcttgtaagtcatcatgttctgttatttcttcctgctaaaccttcctgggctctactttgtgttaccatgcttttgtttctaatagtactgttgtaataatatctttccaagttctctcttgttgttttgcaattcattctctccaatgctgtctcagtgatctttctaaaatggaattctgattgtatccttcagtgttttctcatttgtcctcaagataaagttggaacttcttcccatgttagtacatgatcatttcatgaccttctcttagactcatcatgggaaactttcttcttcaagcctctttctttttactttttttttgagacagagtctcgctctgtcgcccaggctggagtgcagtggtgcgatctcagctcactgccagctcggcctcctgtgttcaagccattctcctgcctcagcctcccaagtagttgggactacaggtgcccgccaccatgcccggctaattttttgtatttttagtagagatggggtttcactgtgttagccaggaaggtctgaactacttatagtacatttctagccaaaacatagagtctctcatacctccttgctgttgcacatgctactgcatcttcctgcaaaatcttccctactctcataaccatttcttcttcttgtctgcttaacctgttttccattaagacatagctgaagcttcaaatccttcagactgctttaggtgtacttcttttaagttcccagagtgtgctttctaacatcttgtgccagttatatagtatatgccttacatacttttaaattgaattatttaatattattccactgacgtccttttttaaagaaattcattaacacttgaaatttaggtgatttattgtttcttagatacagcattttgtatcttcatgcatgttgatatttttaagttattttcctgcaaaaatttctgagagcacaaatattgggtcaaaattaaggacacttcttatgactcttgggcattgcctttcaggtaatgattcttaatatcaatcttgcctaaattacatgttataggtatagtaattttcagaaagcaagactcttggtgctgataacattttctctgtgtaaagaaattttttaaaacggatacataatattttacatatttatgtgatatatgtgatattttgttgcatgcgtaaaatgggtaataatcaggtcagaatatttggactatccataaccttgagtatttatcatttctatatgttgagaacatttcagtttctttctttgagttacttcaaaatatacaatacattgttgctattagcctccctactctgccatcaacattagaacttataccttctgtctaactgtatgtttgtactcattgacccatttctcttcatctcctgcaactcatccacacactcttcccagcctctggtatctatcattctactgtccaccttcatgataccaacttttttagctcttacatatgactgagaaaaagaaatattttatcattaagaaaaacctaatcttgacctaatattaatttttgtattctataaacatatatagacactattgtatgttaatctctgtacaaggcactgggaacacatatagtaaaagtcttcccctccctgtttctttccttggttattttcaaaatcgatttgtcaagaactctgaaaagtaacgtacataatataattcatacatgtttattgtactcattggagctgcctgttaaatatgaagaaatatcaatgttatatttaacctattaatgccataagtgtaaaatattttgttatttatagtttagggaatggcttaattacttgaaaaactgcctttttccatattaacatttttgcttttatcttttagattttaggaaggttgttttaattaggatcagattttaataatgagcagcaaaaatgaggtgcttttttttggaaaatataattagtagattgctgaatgaagttcagttttatttttttaacaagttgaatgatgattaggatttataatatggtttatttgtgtgtacttcttaaactgttctggtatgtttcatatatccatattaaaatacaagtagtagatggttatactatttctttgtacatgatatccacacaagaactctttgtactgttggtggtagtgttatacagttccacactatagtaagtgaatatattacctcaaccattaatcagcctaccattgccattgatgacccaatgcttaagttgtaacactatgctgctgacccagactctgggggcttatttttattttttgatgcattgctgtaggcaattttaagggtgtggaaccaagccattttctctcttggactcatttccacttttatttcctatgggaggcttagccttcctttcaaatatttgaatttctaaattgttcacctattctgtgattactaggtggaggagtaatgcccattttaacatactgaatttaaaaaaataaaatggcttaactgttctcagaaaataaaatggcttagcaattctcaaaattaaaattttgtaatttgtgaaatgcttttcttatagaaactttatttttttcatggattacttttattttgtgcttatgtgctaggaatgtttggcttggtttttgtccctggagagtgcagttgagaactgacaggttatatgaagttgaaaagaaatttaatgagttgtaaaaaccagtgtttcatttttccttggtaactaatatgtacttgtgaggaagtgtcctaaaaaatttaaaacgaataggccttcaggttgcctagtagctttcaattttaacattaatgaatgtatctcaaaaatgaaaataattttattcactaagaaaaatacagttattttatttttagaacgtgaatgtttggggcttgaatttgctggccatagttatccaatctcacagataaaatatatgtaatccatatagttttaaagtttttttttttaaactcacttttagtttgtttcctttctttatcaagaaattgatggaacattctacttgtaccaggtacattatgaggcactggggtttttaatgcgaagaaggtacagattgcgggagctcctttaatagggaaacagatatataagcacgtaattataatagtgtgtggtaagtactgctggacgttcaaaaggaagccgtgagaaaacagcagatgattatatttgaaggcttcagagaagagttgacattttcaggttagggtgtgtgtgtctgtgtgtgtgtgtgttaatgttagtggaggatgagtgtgatagtaagctcaatcatcacatgtttcacataaaatgaatcttctgtgcgctgttaaaaatggcattttatttgtaggtataaggagtgatttttgaaatggaaacaggcctggttaggttttccagaaagttgaccctgtgatggaattaggactgcaaactgcgtactagagagcaacacctgtgaaaaaaagggtcgggaacaagattggttggaaagagtcatcacattgtgaagctgattttgcagtctctgggcaacccagcagggacctctggaacaaaggttgttggaatattcctgcattagtggaaatggctaggtccttctaccaccattattcaggcattggctctgggcttctccatgaggagaatgcccttggctgaaaagctgaagtcaacttaataaaagctaacagctgaagactgtcagctaatcatgctccttgtagccaggcaatgtgttctttgttgaaggtgggggtggactttgggatgatactaattattcatggattgattgattgattgattgattgattcagtgagtgttaacagtttgacactatgtactagggttagggctgggtatgggtgataggaacaaaacagacatgtccttgttctcatgtagagaaaaggtatggaagaagaattttctaagcaaacagaaaatctgatataaaggaccgttacgggcaaaaccttggcttaaaggagagatagaaggccactttggctaaagaattctgagattaaaaaaagagattacagggaaacaaggtcagagagtttggcaggtgtcatactctaaagccttgcaagccacagtaagaattttggattttattcaaatagcattgggaggtcagtggagggtttcaaccaaaggagtgatacagtttgacttatggtttagaaagtttactcctgcttacctgtttccacattcaatagtcataatgcaaatatatcttgacttctgacttatacaatgttgtcacttggataattctttcacatcaccagtaattgtgtaacatctgcagaaaacacacattaattccattattagagtttatttttcccattttctgtgtttctgtagtaactcattaaccagttattttgcttttaagtaactattactgaattgtaagagccatattaattttaatttttagttgggtatatagaacttattatacatgttggggttttttttgcctattcatagctctgaaaaaagtaaataaaatgcttgtgtaggaattttatttaggcattttaaactcttcatgtgaatatcttgagtcgttaaagtttagtcccttactcgatccatatggctctctgttgtagtacaggacacaattgaaagctcctaggtttcctgcatatagcagggacctgcacagtgctgccttctagaactgcttttattttccttgaggtcagaagtcctcctcccataggaaattttagatctcattcccctccaaaatattgacttgcctaattgaaagttattttattcatgttgattcttatttaagatttataattgtttatgaaaaccaggttccagttctgagaaatgtcttctcagtaccaaagtttgaaccttggccacaccatttgttaaccatatgatttaggcaagtctctttacctctttaacaatcagtttcctcctctgtagaacggggaacaccggtagaacttgctttatagagtatagtgagaagtaagtgaaataatatagaatgtctggtataccatgactgttctataaatggaaattgttacagttttactgttacttttaatagattattactttattagggatagtagaaatgcagattcaagttgggcattcatctgaaatctactctggtttcagctttggccttggcctttgggaaattgaatagcagcattgtcacttcagtgtcatttgtggcattcctgaatttgtgtgtgaaaatgcttaccattatatctagcagcctaacatttctttgataaatgaggcatgtcatctggactttttgttaatgtttcagtgtttatttttaattacaggtaagcattctaaatgtaatagacaatgaacatatgcttatatgctttatgtgttaaagttctgtcaatgagttaaagtataagtgtttatcaccagagtaaaatactataattgtcaataattgtagaagctgttagtttcatgtatagaaatcgtgatttcacaagttcaaatattaggtcaggagattgacagttaacacaaatactaacctagtacttttttttttttcttgttagctggatatatttcttttgttgttgttgttgttttctttgtcacagaacactgtttgcagtagaggaaactggtgttgcagtctggtggtataacggcttgctcacataaaccagtacatgttcatcctttagtgcaagaagccctaatggcacataccctattaaaattcacggcatctccaatattctctctctctttttctttgtcatcttttcttttttaataaatgttttcaaggtttgtctaaaagaaggccatataggttcttggctagcagaagacaattcagaacagttgttgcacaattggactctcaccttctccaggctggttgttgatatcttattttttttccaactcatttttattaagaaaataaatgctccaactatcagttttacaaaatctctaagagaaacacaagagcaaggtgctgaggcaaaaaacacctgaggtagctttttctgtgtgtttttctcatttataaaatcggtaaatttaacgccctgggccaacaaccttgtataaattgctactttccttcacatttttttaaaaaagaaagaaataattttgctgaatattgatggcttatacaccaaaatgcaaaaagacaaaatacattctttcattgtggaattttttctttgtttggttgattgattggtttggtgggttcctgttttcttcttccaaaatgctaggacaagtaccattgactcttgttcttttgagtaaccaagcgtaagttgaggctgacgtgtgtgttttgcttttgttccttttgtgtgttgggatactcaaagcactgctttccttgggcgggggcgagggtggtgttgcgtagatatgggattgagatggagggatgagggaattcaaaagaatggagatggagaagtaggggaggggagggaggtgagagataaacagagagagagatagagaattatatagcagtatgcgaaaaaccagtttaaaacccatgaagcaaagagaaatggatgtataagctagacaggcatgaggagtgacagagtttccttttcaaggagatggtatccctcctgttgatatacacagatgatccataattgctgtgagtgtccttccgacaagatttccctctgggtgaattttgtgtaggtcacctcgaagctcctctctacaccgtgaacctcccaaagaaagactttaaagtctagaaaagcctgctttctctttaaaaagaaaaaaaaattaatagttgattaaaaattggaattagttgagttatttgatatgttatttctaaaacatattaccgctgcaggcaccctgcgtaacccgcaggccacgtatcttaccatcgtccccttctaatatgtgcacacatgtacagagatttgccacaaaaaagggtgtgcattttgcatggctttgaacacgttcacctatgttacttcaaccaaaaggtacagcattgtgggagttaaggagagatctgagtggatggtgaagtggattgctgaagctgcagaagtcctgggaggtaggaggcagggcccggaggttctggcaaacctggctgaccttcccccgcctccttggcccctgggattctcagggcctctgcagagtccctggccgcctccgcagacttctcattcctcagatggtctttggtttgcttccgatctggctggctgtgtttggtctcattttgtcaggtgttggaagggctccattcatctgttgttttgctgatgcctgtgggaggcctcacttgctgcgctgtgaggcgactccctgagggtatttctactcctgctgcttcacctcttgtacagtttccctgatactgcgctgtgcagtctggctagcaaagaagtgcccgataattctgatgatcacttcctcattttcatcgggcgtttggtcacgaggcacaatgatttctgcactagttaagttatgcagttcattcacagtcttgccacctttgccaatcacccggccagctgtggaagagagcactctgatatgggcttccagcttcacttcttctttggggttaaagaagttttcttcttttagtttcccgaagatccgtccctgggccttgatggaggctctggcgagtcttgccagctgtttgatgtgtgcccctttcttcccgatgatggtacccacagcctgggttgggatgaagagattcacaatctcctgctcttgataagaatgctgatgcgggaacgggccaaactggtgatgggggtacaggctggagaaagtatctggagtgggtattaacagccagcatatcattttcaaaggcctcacgcagcttcttcataatctccatctcagcactggcataggcctccactgtgcccttcacagtgatggttctttccgggttgcatatgctcaaatcctgcaaggatgagattgttatcttggtccctgtttcatgttcatttttcttcacatttctgccttcttttccaatcagtcttccaaacaagccattgtgggccacgattttcagaggaatctcttcggctagtttggtctcatctgcctctttctgcatgctttcaagaatcgtgtggcatgcttcagaagtcccctctggggtggcatggatggtgacaagcttctctgcagctccagagttctcttttctatggatgtctacccgggactgggtctgctcagtgatgttcactatggtcaagccctcctttcagaccatggcaccaacaaactgggttggatccgcagcgggaaatcagtctgtccggcctgagaagagcccccagggcgtgaccttgctcccggaagagtggtccccaccctgggctcgctgagggggtaaagggggagctcacctcttcatccaggatgtaggaaatcttgaaggaatagttctcaaactgatgcccgcttagctcctccatggctattttgcttcttcccttgttgcatatgtgacattgacaacagcagtttctgtgtctgtgttgacttgttccacattctccactatcccgtgttgagccaaaggtgcatccaacatcgcccactgcaggtgaggaggtatgtttcaaatctgaattttcctgttccttagctttttagagaccgagtaatcaacttccatgattttcccatgcaattccactttaccttggcctcgccgccgccccgccccgactctacacgccggtagggaaggggcttccgcggggttggggttcaggggccgcagggctggggttcgggggccgcgtggctgggagcagagcttgtgctggcgagagttgggtagtgcgctcgcgcagtccctagtacattattaactttatgaaagtctaatttttctaagtcaaaatgttcataaacatttaaataaaaataagacattaatggaggttgcattatatcctcattctttgtataatttataaaattgtttaatgtacaagcattaataaaacatttaaactatatacattttctatttaattgcaacaagtctcccaaagtaatgccctatttgggatttattcacatttataagattgaattaaaaggagaaatagaatgtttgaggaaggggaacaaaatgattaacagtatccaagaaaataatccttgactcaaatataataatgaaaaaatatgaagagtatgaaaagaagaaagtgttagagaaaaattagatcatctagaacacaccttactttctcagtaatcttaaaataatagaattttacaagagtgctttacaaccatttctgtgtagatttttaattaatgaattgttggtataggggaaagaaaatataattagttgctagaagtatcagcatcttcagtgcttccaaaaaagtcttgctcccacatctatttcagttggaattgaacaccttctttgttactacaaatatgtagagactatagtaataatgtagcagctgacagcaggtgagaaattgagtaccatgctatcgtattaaaaatcaactcttaacatgcttaatagaaatttatattgaaaatttattttaaataaaattctacatttatctttgtattccaaaaagtcattctgcaatgatatttggcttttgccgcagcttagtagtgtgctatattttaacaatatggaaagtagtaaaatctgtaccttttctgtgtgcctatcatatttattaatttacccaaattatacagaatgttgggtaagtttagaagaaagtatttttaacagcaaaatcctgtgttttcagcctacatttttttagaggctagtttctattttaattaataatttagtaggctgcatattatatataaaatttaaagaagtttttgtgtttcaacatagaggaattgctaattattttcttcttaagtgatgcgttacattaaatccactgaagtacttttcaacataatttattacacaagtactaccatgtaacacattttcagtgttatttcgttttccctcagttctttcatgagatagttattagaactacttactgtgaattagagataatagagacataaaacaaaaatttgcttttttcccttctacagtagaaaacaatggtaaccacttatttatttcattgtcaataaatgaaaatagaatagtgtctactggaaatgggtgtggagatcttaaagtttaaaaacagctgcgtagtatccgaataagtaatataggatgcattttaacaatgcaagaactggtttgatttaattaactgtggtttaatatgttgtgcatctcactcatggtataccatggtggcatttactggctgatgcttcaaagcactactgtttttcatccactatcatgggtcaattgtgttgtagaggcattatctaaggtctggaaaacagttctcaaggattttgctttaatgataggtgtaacatctagttcatttgttgatgtcaattttttttttttttttaaagacagaatcttgctctgctgcccgggctggagtgcagtggcgtgatctcagctcactgcaacctccgcttcccaggttcaagcaattctcctgactcagtctcctgagtagctgggattacaggtgtgtgccaccacgcctggctaatttttgtatttttagtagagacagggtttggccatattggccaggctggtcttgaactcctggcctcaagtgatccacctcctttggccccccaaagtgctaggattacaggcatgaactaccgtgcctgacctgttgattttaatttgatgtaatctctaagctctcttcttaatgactttaaagtttgaaactgtaatgtttttaccaagtagcttttaaatgatgtttcctgaaggacagaacagataaatttgaatgatgtatttctaaatacagacagcagtgatcttcatgtcctattacattcaccctataaaatcacctggatgtttttaaaaaggcaaatggagaatggagaaaaaagaggcattgctcacgtgatgtgtatagtgttctaagatttcttacatttgataatgctgtggtagttatcttagatataaagtagtttcaaaaattccagttctataaccacatctgatagggtttagctgtgtccccacccagatctcatcttgaattcccacgtgtcgtgggagggacctggtggaaagtctttcctgtgctgttctcatgatagtgaataagtcttacaagatctgatggttttaaaaagagatgttccccttcacaagctctctcattttttacctgccaccatccatgtaagatgtgacttgctcctccttgccttcccccatgattgtgaggcttccccagccacatggaactgtaagtccaattaaacctctttctgtaaattgctcagtctcgggtatgtctttatcagcagtgcgaaaatggactaatacaacaccttaacttttgaagtaaatgagatacctgacggtatttccccccaagtaatttgtgtttgcttttacagatactttttggattacttgattaaaaatgcaaaaactactataaaaatagaggattatatctctttaacattttatcactgttatctttcaatacattgacaatgcaagggtaatagttgagggtttttgtcaaaatgttggggtaagcaaccaggctaatgtaaagtggaggcaaggaaaatgtttcagtgaaaaggaaaacaggccatgtaaatatattgtcagtgaaaaaaagaaatgaataaataaacatttgataaaattaatgactgaaacagaaaaaatcacgaatgtttttggataataggctataccacagggatatagaattaattgaggaggtgatggtgagggataaaagactacacattgggtatagtggtgtatgctgcttgagtgatgagttccccaaaattagagaaatcaccactaaagatcttatccatgtgacccgaaccacctgttcccccaaaattattgaaataaagtaaaataaattttaaaaaattcatacaaaaaaaagaaagtgtttgttacctgacctgcattgtgcaggttggggttatttttttttttttttaattaagaatggcaaactccttctgaaactcttaatggccttcgtttctccaatttcaggtcttgctgctctcatccctacttcctataggctgtactaccagtaagcttctgtaataggcctctaggcagtcccagttccttccttaggtttgtgggtcgtgcttttccattgcctggagtacttcaatttactctaccctcatcctcttatctagtttacttttctttatccttgagtatactatagaccaggataggggtccctttataatttcaaagtgccctatacttccactgtcatagtacttatattaattgtacacttctctaaattagtgtaagagtttgtgggagtgtgtgtgtgtgtgtgtgtgtgtgtgtgaaaagacaatgtctttagttaataagcacaaaataaatatgttttgaatgagtagattctggttctagtatttactattttcagatttaggaaacaattaaatgtttaaatattacttcttagtccactctggggggattaggggaaaactaatggccatggggcaagcttaggtgaaggatgatgcttgagctcagctgtgtaggataagttaatctggagcgagttgctgataaaagtagaataaattttggtaagaacttttcctccagtgtattttggcatcactttgtagaataaaaaataagttaaaggatgttagtctataataaaatttatattgatacttcatgttaatactgacagttattggctagtttatcttattttaattaataataaagctaaaacaattgtttttaagcactaagagaaaaactgtgtcttgaaaaataaatagcattacgtgcaaaacatgtaatatgccaaccggtggcattttgcttccctataattattatcaagtgaatgattagattatcattctagtgatatatctaaaaataaatttatttcttatttatttatatgttatatggtaaatcttatatttagaatcttacaagggaagggaaaaacatctttttcccctctccaaaaatctactgagagaggaaggtatttatttggcttacctgaattacatgagacaatatctcaagatttcatctgagtaagaatcacttggggttgtgctaaaatgcaggttcttaggccagtcctgtttttgttggtgaggcccttacatttgacctttaatgagcatcccagtgttatcacattccaatgtgataacaaattggaaaataatgtgtatttcagcaattatgtaattcagatactaatgactgacccttattctcctggccattgagtgttgtggctgacacattctatataaatctgaggttcttctcaacaggttatatccaattctgtcataaatttagagtaatcttaagtacattgaattaagtgttacttattgaatgcatgacatttcacctagaattgacaaaatcagtcaaattactttattcttatcatctggataccctattttgccgagtaaactgtgttacatgtggttttgtttattacagtctgtgcaaaaagaaacatcaacaatattactgtcatttcactttggtgtttctggtattccactaatgcctcatttgtaatagttaggtatatctttatctttctagtaaactgtttggtttttaaagaatactcatcctcagcatttaacttttttctagatgacagtattttgggcctagggatactgatgtaaataattgacacagaattgcagataaagagaggttctgaggttaagaatcagttcagccagagtcaatctaaagcatctaaggctactaggaagctttaaggagccatgaatcatacttcagggacccaacagtaatgaaggtgtccaggttgaatccaagcattttctgtttatagttaaacagaacaataagatatgcaataatttaaagacattaaataattataaaggtttcactctttcctcctcatttactttatttcctactttagatggtattttggtggctcagttaaaataatacttaataaagttaggcttcatgtagaggggtaggatttgtatcagattaatgtaacttctaagtccctttatgcattccagataagaggaagtgtgaaccccctgatgccagagactgctgtttcttgattactaactctttgacctcaaaattcaatgaagtttagtatattaggcatagtgcattcaagctcattttctaagttatctttcatgttttgtcaactgccaggtggactctgggcattttttggggaaatgtggttaaagcagccataattatcaactgcttgaaatacttacccggtattttaaagaatattaataaggcctcatttaatttggttcgcagcttttagatgattgtacagtgatcatgatcatgtcttacatttttatatattccctagccatttaataatgtacttgagaactaaatattttaatagtatttccttacagtctgatacagcagcaatgttaggtagttaaatgttgtctactacataatattgagctcaattagcttgaaatggcaagttcatctaaagtacatatgaataaaagggattataagtatagtgaagtgttacatagaactggtaaatattttaagtatatgtactcattatgatttctaaatattatagccaaagcatgcagttacaacaatttccaaacattaactgtttgaaaactctttttacattttacgcttaataaactaatttgtacataagccacattattatttatatttaaaactaaaaaaaatcactttctccagctattctaacaaaaacttagtaagtaagcattgcttttaaaatgacacaatctactagttatttggtaagactagcataatcataaatttcccatccatgctttttccaaaaatactaacccatattgttctctctggacctgttgtagggatgactaatccaactgctgaggtctccctttatgtgtttgatggaacacttggcttgctggactacagctgtgtgtttatgtgcagtgcacacctgcaggggcctgacaaatagctgtagtatgcagaggatacaaaattaccctggcagtgctgcaaataaggaagtttctgttttgaagtccatatgtgtgtgtgcttgagatgccagctggtgtatttatgttgcatgcacagatgtaaaactgccaactgattttacaccaaataaagtctaatctttttatatgtactttgtgtcaaagttatgaagtggtatgtaagaatattctcatgacttaggtcttttaaaataaaagctgctattaaaaatatgaactcataagatgattaggaaagagaggaaagaggatagtgatagagatggtatttcttaactattatcctgtgtataataatgttgttatgactatatcattagataagtaaagttttgatttattataattatgaatgatatatattctcttttgtggctagagtcagtcaggtctttgtgaaatcccaatttatgaatactgaaatgtgaaagacaaatttatataattacttgacttgcaggctttggctattctatttttcaagtacatttgattttaacaagttgaaaggatggtgcacttttgccatttttagaatgtatttaaatttgttctgaaagaaatactagtgtttataaataccagggataatatttcccaagtctatggaaattttaaaaccaatataaaaatagtggaaaagccagttattcaaaagaacctttgaaagaagcaattttttttgtttcttttaatatgtcttctctaactaaatgaagaaatatattttattgactatatccatcccaaacaagaataatgatttgatcactagaaaattgatcttcaaattaatatttgcaaatgagatactttatgtctgttacttaagtgtaaacatagattagagtggaagcttttgtttaaaattagtgctggatatattcattttctctaagaaccatcattgcttatgaagcagtgatttttttccatatataattggtttctttttttttcttttggagttggagtctcgctattgtcagcccagactggagtgcaatggcgtggtctcggctcactgcaacctccgcctcccgggttcacgctattcgcctgcctcagcctcccaagtagctgagattacaggcgtccgccaccatggccagctaatttttgtacttttttagtagagacagggtttcaccatgttggccagggtggtctcaaactcctgacctcaggtaatccaccccaccttggcctcccaaagtgctgggattataggcatgagccaccgcgccaggcccatatataattggtttctaatattaatggatatgtttcagttgaatcattttcaaaaatattgacttttactgtatttgaaatatatgtataaattaagaatttttagacattgctcaacaagaactgtttatcagaatggttatatttgtttttgttttatttataacctctttattgttttgtctcattttatatgtataggtttataaatatttgcaaatggagcaaagtagttcaagtgcttatcaaaatcatgttaactttcttattagaaaattttaatggtaatgtaaaaatacgttgtcatatgtaatcttgtattcagttttgcatctgaaacacactgaatttgtctttcacctaagtatatctagatatattgattcttctgatattagtgtaagttatacttgagttctgactttttacttatagaattgccttatcatagttccttatttgactatattttactgacattttgtatgctttcctaattattatttttattgatagcgtcaaacttgtaaatagtttgtaatgcctttacaaatttaaatagtgttttaataggcatgattcctttttcttcaatggtaggcatgatgcctttttttgtcataaaagggatgtatatttgccattttatctagcaaaatttcacttgaacttttactgtaattaaatttcagcaaatgtgggaaaggcctgagcttttagcattgtcccttagccttaaagtctaaattttgactaaatcccggcatcttaattcatgaggaaagtttgatttggaataagttttatataatgagacaggaagatggactagaaaccacatctcccagtggttgacctgagggataagatgtttctgacaaaatatacaattacttgtatgacaaaaagtgcatgaagaaaccaagtacctcaatttccaaaatgaaaggcagtatggtatagctgaatgaactcttgatcaggagacagacaaaattctagccctgtaacacacagttgtatgttattaggctagtttcctggagctttagtttagtttaatttttctaccagagaaagggaatagtaattctgattaatattgatgtgagtattaataataagataagggacataaagctgttctgtggtcagggtgtggagcatgtagtaggtgttcaataatagttgacttttttttttaaagcagtagtagtaacagtttgaaaaagttcattacataggaaatatacatgtaaagttaactcagaaaaggatagacataagaaagcttcactgatgtcttacattttttcctgaaaatatattttaaagaaaggaccaaacctcaaatttttacagctaaaagaatcttttattacttatttgagagattatgttccatacattgcttggttatttagtgctagggccaactgcctttagtaggatatcacttcaaacgctgctgccgccactgcaggttgcaagcatatgattgaaggcttctagttctcagctcatgcccagatgtctttcaataactatagccagtaatttcttcaaattgctcactttatcagcagcacatgtcatcaatcctgaagtggttgctcaagtcaactgcagaatctttagcttatagacacagctgcaaacaggtgaacaggcagaaagtaatttgtgcagcttggtggctgtcagacgaaagacagacaatctgtgtttaaaacagattgcaggccctgtatgggccagacaaaagggatttctccaactgcaaataattctaaggttaacatattttcctttctgccattaggtgatttgttaaaattggaaacaatgaacattataaatctacacagaaactggagacaagatgaaagagaaaatcagatcactaaataggtttacatttgtctttccaaagaagtataactggcattcatataagctgttttcttacaaattaagccaagttataaaataattctttgaaactgcaagattataaatatttcaagttgcattaagaattactggtattaaaaaagcaatgaaccctgaacagtccagtttttataagcaggttttagagttaattgttaatttgtagatgttggaatttgcttctttataaatattatttagtgtttttcttgcagctttactaagtagattttaaaagtagcatatgctagatataacacacttttcagcacataaaatctaccatggttacagaacaaaaattcgtatggagaaaaatattctgaggacctatgcatttaaaaaagttatcctcacattttcgccttggagttattcggataagaatgtgaaagatatctgaatctatctgtaaaatagtcatattttagaagatagttctataataacactaagagtattcatcattttgtccataaatctcaaaatgataaacttatgagagtctgaatcagcaaagttatttttcatcagtattagtccatataagtgcctactcattaaactaaacaggaagaaggactatattacattagctaaatgagtacctcatgactgaagatagacacacacaaagtttagatatttaaaatatgtgtacatgtgtggtgcatggatgcatgtatgtgtagggaggaacacatgagaaataattgagtagtccttctttgttatctaccagagcttatggctatgacatagagaactgtaagtgaatgttactgatttattctcattgttggctctcttgtgctttctctcttgtttcacaatcaatttagtacggtaattgtttttaatagataatgatctatataacatagtgtttaagaacacagtcctcagtgtcaaattggatttaagttccagtttgataatactgtgtgattttgaacaagttacttaacctatcaaatccttagtttttcagtggtgatagtgactgtttattaacttacgttgttttgtgatattaaaaactcatatgaagtattgtgccttgtgccttgtacttatttaaagcttcaataaactttaggcattttctgctacaatccaaacatcctgaggaaagggaatgtttttgtcttgctcttagctgcttcctaagcatttattaccatgatttgaaccgctaagaactcagaagtaatctgaatgaacttgtcaataattctgtaatttttagagtccactgtgctgatttcttttagtcataatattcctttcttgtcaaatgccttgaccttaaatatgagaataattcttatttatttatcaagacagagtcttgctctgtcgcccaggctggagtacagtggtgcgatcttggctcactgtggcctctgcctcagcctcagtaatcccaagtagctgggattacaggcactcactactatgtctggctaatatttctattgttttagtacagatagggttttgccatgttggccaggctggcctcaaactcctggcctcatgtgatccacccgcctcagcctcccaaagttctgggattacaggtgtgagccgctgtgcccagccctgatttattttttgagtatagacaaagcggtatgattattttactgtctctcatttcagtttttctaacattaggaaattgttcttgattacagctgtttgtcaaaatatagctagctgtggtgccttatgctcacagaataatctggcattaaaaatcaattatattttactgttttttgttttgttttgttttttgagactgtgtctcgctttctcaaccaagccttttggtctccaaacttgcccaacatggttccactccattctttggccaaaaatcaatgggttcaagaacacaagttttaactgtagggcttaactttagatttctcatatcaaaatcgctttgcctctagagcagtagttagagcttccaatatatgctgaccttcaggccctacaccatacctgttgttttgaaatctctgaggatggggcctggatgttgatctttcaataaaatctttttgtgtcaatctaatgtggacccatggttgagaacaagtgctctaggacagcgactggcaaggtatgacccatggaccaaatccagcccatcagctgtttttgattcgaatgcagtaaccaccattatttggctggttagttattatcaatggctgttttgtgctacaacaccagagttaaataaatgcaacagagactgtcttgcaaagcctaaaatatttattatttaacccattataaaaaatgtttgctaacccattttagattatgagctctgatgcggtggctcacgcctgtaatcccagcactttgggaggccgaggtgggtggattatgaggtcaggagttcgagaccaccttggctaacatagtgaaactccatctctacaaaaaatacaaaaattagctgggcctggtagcatgtgcctgtaatcctagctactcaggaagctgaggcaggagaatcactcgaacctaggaggtggagatctcaccactgcactccagcctgggcgacagagcaagactctgtctcaaaaaaaaaaaaacaaaaaaagattatgagctctgattatcatcagttttgcacatatttcgtgtttgttggtactttaggcaatctattggtgaattagctagatatttttgattacctttctatttcttgcctaatagatagtgaactgtttgagggcaggcactatattttatagctctttaaaatcctcaacccctaatatagttaattttgcatagttgggtgtaagtaaatgttcgttaattgactctagttattggcctttggttattgcatgaaggtaccagtaagggacagtgtggagcttttgctttgtgcatgttcaattttttttttaactccttctattaaaatagacattattgtattttagaatattaccaagtcatcattttataattatagaaaatcccttaattttttccacttctggaattactgtcaaccttcattactcattgtttgtacttaatgtttagatctaagctacaaaacagcataccatattttcatcatcattactcttttaaaaatttgccttcattccagtttcagggagtttgggcaatgcctgtgatatttgtgtcttgaaaatatctcagtggtctgtcagatatgaggttgatccaattttaataatagttttttctacttcctgatctttaatgggttgaaattatcttggcttttactggtagtgtagtcataataattttttaattgtaggtgctcaagagagaaaacagacacaaagtgttctgtattggttctatattattcccctggaatgatgtgtttaactagttttcttttaaactatcaactacataaattttgttcaaggctggtgtcttagcatttgcgttacaactataagtagtacacatacatgtcttctatattcatttagaaagatcactatcttaaatttttttttcatttcacttgttaaatatagtgaatatgttatttggggcagggaaaaaaataaggcaatcaggcaggttgctgacggcagtccaaatggctgatcagagagtctttatatgcattggtaatgtgttgtgcaatataagctgaaatatattccacaagggaggaaaacggaataggttacatacactgttcctaagtgcaatgaatataaaactccattactcactttaggcaggtgctttttatatgaggctttaaagtaatataaaactgctggtgaaatgattggtttatacagacaccacttagcttccagtgctctaaccagataaagagactaaaactattaagatatttctttaatgattcagggattgatgtttaatattcttttggtataatagcctgtccctataacattgtatagttatgaaatttgtgtgtggctgggttacgaaagacttttttcagggaaagaggaaaaaatttcttgtttttctttgttaatgataaggaaatgaatctccccaaaatttctttcaatgtatacatatatagaaatatatatatctgcatttaaaaatatttttgaaggactttctaaatacatttcttggtagtttttttcagcttttctccaagaatgactgaacattttataggcattaagattgaataaattttgtaatgtacaataactctctttaggataactgtgaagttggttgatgaacattataaagcattaaaatatgtattagtccataaagatttgcagtgatcccacctagatatacaagcccctatatttctcgtttttgacacttttaactcttacagagaacaagtaacctgcttattgtttaaacactgaacattctcttatgagtgaatttttataaactaaaagggatgttaaaaggataacaaataggtgtttttcaaatttgtcttaggttttaaatatttgaaccagatggttttctttctaaatctgtcattgattgattgattgattttccctccctcccatccctcagtccctccatgtctccctcccttgagcttctcccccactcccaagcccacttccccttattaggtgacatttacatacaatcaactattttagagtgtatgattcagtggcatttagtgcattcacaatgttgtgcaactaccaggtctcagtttcaaaatctttatatcactccataaaaataccccatagcttctaagtaattgctcataattcctcctctccctcatcccctggtatcctctaatctaatctacttttgtctctgtggattttccttttctggacatctgatattaaaggaatcatatattaatattatgtgaccttttggttttcgccacagatctagccaagttgttgtgtgtatcaatagttcattcatttttttattgctcataatattccatgatatggatgtaccacagtttgttaaatcatttatctgttgaaggacatatttgttgtttccagtttttggctattacgataaagctgctataaacatttatatacaagtttttgtgtgaacatgcattttcgtttctctgggactaatgcctaagagtacagttactgggctatacggtagttgaatggtttttttttttttttttgagatggagtcttgctttgtgctcaaggctggagtacagtggcgcggtctcggctcactgcaagcccctccctggttcacgccgttctcctgcctcagcctccggagtagctgggactacagacacccgccaccacgcccggctaattttttgcacttttagtagagacggggtttcactgtgttagccaggatggtctcgatctcctgacctcatgatccacccaccttggcctcccaaagtgctgggattacagatgtgagccaccgcgcccggcctgaatgtttaagttttaaagaagctgccaaacttggggccaggcatgatggctcatgcctgtaatcccaacactttgggaagctaaggtgggatgattccttgagcccaggagtttgccgaggctgcagtgagctattaccttcgcactgcgttttagcctgggtgacagaggaagaccatgtctcttgcggttgggggtggtgggggagaaactgccaaacagttttcaggagcggctgtacattttacatttccaccagcaattgtatgacttactggtttcttcacatactcactggtatttaattttgctgctgtttttttattttagctgttgagatagatgtgtagtgatatctcattgtgattataatttgcatttctctgatagcaacacaaatgatgttgaatattttttaatatgtttatttgctatcagtgtatcccctcagtgaaatgcttgttcatgtttttagcccattttctaatagtattgtttgtgcttttattgttgagttttgaagcctctttatactattctagatactagtccttcagctatatggtttacaactatcttttctcagtctgtagcttttcttctcttagcagggtcttttgcaaagtaaaagtttataattttgatgaggccaatttttttcttcttatggattataattttgttgttaagattaagaactctctgcctaactcagataccaaagatttccccctatgcttttttctgacttaatttttttaaggtgttagacctagatttggcattaatgtttttgcctatggcctattctagcacgatttgttgaaaaagactgtctttctttcattaaattgtatttgcacctatgtgagaaattatctggcatatttttgtctctgtttgggttcttcattctgtccactaatccgtgtgtttattcttttttttttttttttttttttttttttttttttttttgagacaaggtcttgctctgtcacacaggctggagtgcagtggcacaatcatagctcattgtaagctcaaactcctgggctcaagtgatcttcccacctcagagcctccagagtagctgggactacataaataatctttgatttctttcatcagcacttttagttttttgcatacaagtcctgtaaatattttgttagttttatatctttttttctgtgattttaaatggtattacattttcattttcagtattcacatatattcattgagaaattgataatttctatttttattttatatcctgtgaccttataaaactaagctcacctattacttctagaatgtgtgtgtgtgtgttttaagattccttgagatttatacatagttatgttaaatgcagagacggacagcattgcttttttgtttgttttttccatttcccatctgtataccttttatctctctttgttattgcatttgctagaattcacagcattaggttgaataacagcagtgacagccaaaatccttggctttgttccagtcataatggaaaacattcagtcttttactattaagtgattttaggtgtttttgtagatgatctttcttaggaagttcctctctattcctagttccctgaaacttttttttttcttttaatcctgagagggtgttgaattttgtcaaatgctttttttgcatcagttgatactgtcatgtggatttttcttctttagcctgttcatatggtggattgcattgatgtttttcagcattaaaccagtcatccagttctggaatgaatctgagttggccatgatgtattatttatatttgtatttacaaacacaataacacatcgctgaattctatttttaatattttgataagttcgtatttatattgatgaggaatctttgtctataattttccttttttgtaatagctttggttttggtatcagggtgattctagcttcataaaatgaaatggaaagtgtttcctccttttctgtgtcctgaaagatattgtgtagaagagatgttaattctttaagatttggtagatttctccatttggacctggagatttactttttgggttcatttttcttccccttgaagaattgattcatctagtcatagttttcaaattttgtgtgtagagttgcttgttttcaaaattaatcttttgataactgcagggtctgtaatgatatcccatttcattccttatattggtaatttatggtttctctctttcttattagagttttttcagttttattgatctttaaaaaacaagttttaaaaatcaaaattttaaatataatttctttattttttaaatttaaaatataaattttgttgatttctgctatctttgttattttttgtccatgcttactttggttttattttgctttccatgtttctggtgttttaggtgagagctagattatggaattaagacttacttgtactgtgcacattcggtgctataaatttctctctctgtactactttagttgtggcccacaaattttgatacattatatcttcattcaatttttttcttctgtttcatttgagaattcctctttggctcatggactatttaggtctgtttagtttccaaatttggggggattttcttactattttttaaaaaattgatttctaatttgaatctaatgtggtctgagaacaaactctgtatagcttcatttattttaattttgttcatttctggcccagtataatattatctaccttgttaggtgttttgtgggcatttgaaaagaatgtgtattctgctgttctataatctagaaacagcttattagttgatggcatttttaacattgttgatatccttgctgatattccgtctatttgttatatttgttgttgagagggtatcgaagtctccaaatataattgtagatttatattttcagctctatctctttctgcttcacatattttatagctatgttgtttggtttatacatatttcaaattgctgtgtcttttcagaggattggctcttataatttttttcctcttaagcctactttatttgacattaaaataaccagtttttttaaaaaaaaattgagataaaattcacataacagaaaacgtatcatacagctattttaaagtatacaattcaggagtttttagcaaattcatatagctgtgcagctttcaccactgtctaagtttagaacatttttatctccccagaagaaaccccataccaattaagcaatcattccccattcctatttccccacagcccttggcaatcactaatctacttagtgtctctgtggaattctgattttgaatattttctataaatggaatcgtggaatatgtaatcttttgtatctggtttatttcactaagcataattttttcaaagtttattcttgttgtagtatgtttcagtacttcatttctttttatggctgaataatatttcatagtatggttatattacattttgtttctccattcattaagagttagatatttgagttgtttccactttttggctattagaaataatggttttatgaacattcttatataagcttttgtgtggacatatatgttcagttctcttggttatctacataggagatgttctgctggatcatatggtcactttctgagtaactgccaaattgttttccatagcagctggaccatatgacattcctagcagcaatgtatgagggtttcaatatctccacatcctcaccaacgcttgttattgtttctctttttattataaccattttacttggtgtgaagtggtagctatgttctaatttttatatattgatgtttatataatctactttttccaccctttcactttcaacttgcctacattgttatatttgaagtgagtttcttattgactctttatatttggagtatgtttctttgatccagtcttccagtcttgtcttttaattgatatattgtgagagcatttatattaaatgcaataattgatatgttagactctatgtctgccattttattttttgctgtttgctatctctgtttttcatttctttttctgtcttcttgtgggttagttgaacattatttgaacattattagaattccattttggcttatgtgcagtaattttaagtgtatctcatcaagctttttaatgattgttttaggtattatatttcacatttctaactcattacagtttactgatattgtgttattccagttcaagtgaaatatagaatctatacttgctcttatgttcctttacccttcctcatggagaaccatatcagatattatttttgcttcaacatgaaacatagtttagaaaacttaagaggagacagaaagtctgtgtactctatttttgcttgctgtattctcccttctctcctgatatcccaaaaatccttattttattcttaactttctgtttggagatctttacctgtccttttactgtagatctgcttatgacacattttttttgtttgttttagtttcccttcatctgagagtgttttgttttctccttcattcctgaagtatatttttgctgaatatagaatttggggtacttttttttaaagcaattgaaaaatgtcatgctatttcctcctggcctctatggtttctaatgaaatatctactgtcatttcatttttccccctctatacataaggtgtagtttttctcttactccattcagtattttttcttttattttcaaaagtttatccatgatgcgttatgatttctttgagtttactctgttaggggctagctcagtttcttaatgtttagattttgtcttttgtcaaatatgggaagttattagcaactattttttaaattaattaatttttaactttattttattttattatattttatttatttatttatttagagacggaatctcactgtgtcacccaggctggagtgccgtggtgtgatctcaactcactgcaatgtctgcccacaggctcaagtgattctcctgcctcagcctcttgagtagctgggatgacaggcacccaccaccatgcctagctgatttttgtattgttattagagacggggtttcaccatgttggccaggctggtcccaaacttctgacctcaggtgatccacccaccttggcctcccaaagtgctgggattacagagccactcttttttgaagtacattttctgtttcatctttttatttttcttgtactggactctgatgacttgaaaggtagatcttttatctaactttctcataggtccttaagactcttttctctttttttccctgtttttttttctatatttcacattgggtaatttctgttgttccctcttccattttaatgattctttccttagccctctccattctggtatggaacccatttattgagtttcttggtttggtcattacatttttcagtactgaaatttgtttgatttgtttttatgtcgttgtccattttcttctcttttttttccctacaaattcctatttctttgccaaaatctattttcatttgcttcaagcaaaatgttaattggagcatttttataatggctgctttaaaatctttctgtgatagttttaccgtctttgtcatctcagtgacatctattatcttttttcattcagtttaggcccttcttggtttttggtacgatgagtgatttttatttgaaacctggatgtttggatattgttttccgagattctgtgttgtgtttaaacctgtgttagctgacttcctctgaaaatgctccagcagtggaagggaacatgcctccacttattactgctaggggatgtacaaatccaggttttccacttggcctgcattgctatttaaggccaggggggattcttgttacttctggcccggggtcaaaattctggctctcagtgaggcctctgttgatacatccctggcttggagtgtttagattgcctcattactgctctaagtgaggcctcccctgatgtcatggtggtgctgaggtggtatgttattgccgcaggttggtaaaatttttgactctccactaggtctctcttgacaccaccccagctgtaagagggaggggcatagtcttacttctaggttgagttaaaagtctaggccttctctttagcctagtcttattctacccaggcagggatgttggggttcatgttagagtatgctgaagatggaagtctaggcttcccacttgatctttgctgttgttggtagtggcaggaccaccatttttagagtggtgtttgggtggaggagaccagtttttgcctaaacattttctgttttgctaggatacctctttctggtcctttggctaaggagaacaggttggggaacttttttctgtctgtacccattggcctttctgggttgctggcttctaggatatatgagcaaaacaaaacccgtgatccttactaccatgacatttgctgggtctacatgtcccttcctttttaaggctgactaatattctattgtatgtatataccacattttgcttatttattcattctttggaatttgggttgcttccatgttctagctattataaatagtgaaactatgaacacaggtatacaaatatctttttgaaactctgtttttaattttgggcacatacttagaagtacaattgctggatcatatggtagttctatgtttaatttcttgaggaatcgcgatactgttttccactgtaccattttacattcccactaacaatatacaagggttccgattactccacatcctggatatcatctgttattattattatttttttaaatagtagccatcctaatgggtatgaagtagtatctctttgtcgttttgatttgcattttcttaattagtaatgctgagcatattttcatgtgcttattatccatttgcatatcttctttggagaaatgtctattcaagtcctttgtccatttttgaagtgggtttttttgttgttatttaggtctagagattatctatgtattctggataccagcgtctcatcagataagtgatttgcagatattttctcagattgtttccctccattttcatagcactctaacttgcaattttcacaatgttgaatatgtatatatttgtgtaatttttttaatgactgcttctctcactagattgtgaatttcatgagagaagagcctgaattggtcttatttacttgtctgactccaggctgagtctggtatagagtagtttcatagtaaatattcattgaatgaatgagagagagaataaaagacatatgaatcaaagttagcaccacacatgaatgaccattagtaaatgatcatgcttaggtgcagacaaaacttgcatccttaagctaggatgaaaatctagtgggcaattacatttcaatgtgagttttggagggaatatatattcaaaccgtagcagcaactgattgccctaaacttaagtgagaaacaggttagagttttgtgcagtagttctttatcatgaattgaagggctctgattgaagtagtaagattggaatcttggttgcacacagagttcttatagtaaaaaaatagcttgttggagtctcgatttcatagttaggtaattagccttgtaggatgacaattttgtgttgtggcattagtgagagtgccttgtggcatacagtgagttaaactaaagaaaggagaataatctgtgcatagtgagtaatgtactcatttttattccagtgtgttctttaccaactccttccaaacagacgtgcatgtgagtgcatgtgtgtacacacacacacacacacacacacgatgtttaaaatatagttttgtctttattatgacttcttttatttctttcagctagtcatttagcttctttagccatgcttcaaatatttttaaaaatctttactgatttctcttattgtgtttataacaaggtgttttaaaatagactctatgtttcctgtgtagtatttttaaatgacctcatttgatttttgccctaatgctgactttttttttttttaagttagtgcccaagagtgatgggtttctctctccttctttccctcttgggctgtcagaatatggggtttactataatatgacttttacatagtagtccttctttagatatttgtaccagtggttattactaagaacttagtttcatgtattttcttcccatatgtattatgaaattaactaatatgagaagcaggcattttgttttttcttgttattattttcatatcaatgccatgtgtttttttaagttcatatatgtggataatgctaaattatcatcatttagttttattttattattttttattattttaaccaataatttaaccaaataacattattattttaaccaataaattttagagaaaaaagcactctaatattgcatcactttgtacttagtttcatgtattttctttccatatgtgttatgaaattgactaatatgagaagcaggcattttgttttttttctcaagttattattttcatatttatgccttttttttaagtttatgtatgtggataatactaaatgatcaccattgggtattattattttaaccaataaattttagagaaaaaaatcactctaatattgcatcactttgttatcggtatcacaacaataattagttatcattcttctcctgacatagctctggagcctatgggggagatatcagagttttggaaagttttccttgcaatatcagtttataaacaaatttatagttattcctttaaaattttatctcagcttttatcactacctgactttgcctagtcaatattttttctaccatatattcaaaaacataactacttcatgtaattaattagcgtaagttttctttgcctctaaaaatgttgaaggtacctgactatattactacctgaaagactgtttatttcatattccattttgtcatatttatggtcttcgatccattgtagataatcatggcttttagagataaaagcaatcatagtcataaccaaatccagtccctgacttttttcaggtgaagaaactgggccacaaagttttaaatgcaacattatacagctttttgatggtagagtttttactagagtaaaggtctagggattagtgtatctttcagtaaactcccttattaatttttaatgtatatgaactgaacttttctaatcccagcttgtattgtttatattaatagtagcaataatgacaatatagtatctgacatttattgagcatttacatgccaaatgcactattaaccactgcccatttattattctactcagtgctcatgattactgtgtgaagtagctagtgatttatgcctgttttacagatgagaaaacttagcgtagtttaataaatttcagggctcatgatgtgtttaatttctttgcatatcctgtagtatttaacctcagaaattatgtttttcttcctcttctatcatggatgaaatcttaggagaaaattcgtttataagctactttttgcttaagaaacatatagcaagacttctaaaaaaatttaaaaaacaaagagaaaatgaaaattagtgttggaagtaggcactgatgctttgtgtgggttcccctaatgttctttggcaaccccactaaccagtggatttggattttgattaccagaagggagtgtgggcaagtaggggggaattggaagtgatattccacttcagtaagctcataatgtcaaagcactagtgaaaagatagaccatttcaaaaatctgtttcactccagatttaacaaagaaggttttttgtgttggccttgattgggaagggagagggtgctttcctggagaatttgtaaccacaactctgtcctcattcagattttaatttcttgcctgacctgggaactactgagctaataagttaaaatgtgatccttagtgggctaattacatccctgagtgtctagtagtaagtacaagtatttgctgtggcacatacccttacctctggcaatgtatgtgaaaaagaaagccttatgaaatgtaaactcataatctaaaattacaaagaatttgaggaaataattcagcaagagtaagagtgagcagaaaccgccagtggccaaattcaacttctgcaatgtcagataatatatcagaaacagtataaaagacttttaaaataattgaagaagtaaaagatggaattcaaattacaagagagacacaagatactatcataaggactacagaatttttataatgaaagaattttttggaggttggaagtccttaatggattaaatggattaaacagcagattagacacagccaaagacgctataagtgaactggaaggtggttataaagaagtttcccagaatgcaacattgaaaatagagatgatatgtgaaatacagtcaacagatctggatgttagaatgaaaagattctttatttctatcaactctcaggaggagaaagtgggagagaagcaatatttattgactttttttcccctgacaaaatagatgtgagatgtgaatcttcagacctgagaatcctaaattccaagtaggaaaaacaaacctaaacctctaagtagacacattgtggtgaaactctggtgtgctaaagataagcatgaacccttaaaagcaaccagagggaaaataaataaatggcatgatctgccaacatatatgttaataattcagtttcctgcagttggtaatgaagatgtcaaggatagagaaaatttatttcttcttgaacatatattatatttgaggcattgtattaacctatttgcaataggttaattggctagaaaggggaggatcactagattggattgaataggatcactagatcacttctttgaagtccacatacaatctagtgatcctcccctttctagccaatgtgagttattgaatcttcttttgagactatatctagaagttacaagttcctcagtattctgaagaaccaaactctgtccccttccaaataaaaatacttaattttctatttctagtctcttgtacccagaaatgttcttattcccacatttggaattatgacatagtagatcaatcaaagttaagtaaataagcttgtaatggaacaagttacttaagtttttctttttttaaaaaaaaacttaattttttttaagagcagttttaggttcacagtacaattgagaagaagatacagagatttcccttatacccccaccccaaaacatgtatagtctctcccctattatcaatatcaatatcccctatcagagtgatacatttgttaccttcatgaacctacactgatgtgtcacaattactcaagtccatagcctactttgggttttactcttagtgttgtacattctatggatttgggaaaatgtacatgttatgtatccatccttatcatatcatatagaatgtttcacagccctaaaatttctctgtgttctacctatttatcctatcccccaccagccaaaccctagcaaccactggtctttttactgtttctgtagttttgccttttcaagattgtagccttttcacattctcttagtaatgtgcgttatcatggcttgatagctcatttctttttagcaataatatttcttgtctggatttaccataatttattcattcacctactaagggacatcttggttgctttcgtgttttggcaactaccagtaaagctgctataaatatctgtttgcaggtttttgtgtggacttgtctcacctcctttgggtagataccaaagagtgtgaatactgaatggtatgataaatgtatgtttagttttgtatgaaactatcaaactgtcttgcagagtgactgtagccattttgcattcccaccaacagtgaatgaggttctgtttctccacatcctcaccagcatttggcattgtcattgaggttaattcttattagtaatgcaaataagttttctaagaatgtatgtggttagtgtgacaaagacatgtaggagagattgtgattcatacaattttagagttagaagcacattttatgtatttatttcatattaagaattatgtcataagcaaggtggcagaatgtattgctttaaattgaggcatttaaaaatcattctgtcactgtgaagctgaacttttacttgtcagatgtttatttgccattgctgtttaaaaaaaagaattacatgtttgtcagtaaatgcttgttgactccttttgctggtgattacagcaatatggacagggatttctgagatgcaagtgggggtagaacgatgaaaattaagctcttactgtacagactttgtgttttgttccttgtgaatatttaaagttcagttctgtcatttaatgatcactgtgagttgtacttttgagattactttttgtttcatgttgtttcagtggttatattttatgttctgctgaaaatagtaagtgctttttacctggatattttgacttaaccctagaatgggtcactacatctgttttttgctgttaaaatcattataatcaacaacaataataaaagtacctctacctttttaagtgtgctgtctcttaaagtttctcttttcagagggagatttttacagtctttgtcacctattgaatcttagaactaactagctttcttggtacacctgtcttattagtatttcctagcgagccacttttatttaggtttttcactttcttcttatgtgataaatcttcccctcatttcactttctccctttattcttcccctgaaaggataatacttacttcttactatatagtatgaaagatttggaagctcttgactatctctttaatgcatcttttaaaataatttacctcttttctctttcagaaacctttattatagttacactctcctgtgattttgttatttcccagtatcaatatggctcctggctgtttgaatgttttggatggtctgttgttgttgttgttgttgttgttgttgttgtttcaaacagggtctggctttgttgctcaggcaagagggtagtggtatgaccatgacgcactgaagcctcaagcaatcctcccacctcagcctcccaagtagctgggaccacaggtgtgtgtcaccatgcctggctaattttttatttttttttgtagagatggggtcccatcatgtagcccagacttgtctcaaactcctgagctcaagtgatcatcctgccttggccccccaaagtgctgggattataggcatgagcttcatctggccaatcttttgttttattttattaaattatagctttgcaaggcttgtaacaaaaagagcagtcttctggcaccctgtcatcctcactgctttttagaggcaatcatttttcaacttattcttagatatgtacctctaaatttctatatagtagtctttgttgcagttttcttatttttgatgtttttccatagagaaagtcagtgttggccctgaaagctaaatcattctctgtgttaggcaggagtatgtagatattatctgcatagttactattgaatatgaggatatattagttttctattgctgctctaacaaattaccataaacttagtcccttgaagcaacacacatttattttcttgcaattacgtagtttagaagactgaaatgggtctcagactaaaatcaaggtgtcagttgggctcctttttacaggctctaagataaaacccctttccctgctttttctagcttttagaaatttcctgaattccttggcctgtgacccccttcccccatctctaaagccagcaatgttacatttccgtgagtgtgcatctgtcatcacatctctttctctgactcttttttgccttctcctactacttttaaggattcttctgattacgttgggttcacctgaataatctaggatcatctccctatttcaaggtcagctgattaggaatctgaattttcctttctgttgtaatatgacatgttcacaggtcctgaggtttagcatatgaacatctttgggggggaccattattctgtctgtcatagaggatctagtttttagggccaatactcatagcctctgtcttttattcctttttcctaaatctttgaatataattatgtcacagtttttgcttaaatctatactcagtatgaacgtattataaacatgtatgtatgagttagaatatgctaccaattgcatttatttttcttataaaacttgtattcttggagttaataactgtcttggagttaataactgtctttttttttgttattgcttgattagtgttctatgtacttatttttaattaattccctcaaactctgacataaacatatcttctctcaattccttcaggtgtgtgagataattacttttaatttttggagtctttttttttttaatgctttttcctcctgtttttctgtttgttccctaggcctactgtagagatgtcttgaaatttccttttatcattgtcctgggatttccttttctccggttggatcccctgtttcttagaccacacatgttactctttcttgatttactctcttttttaggtggagcaaaatcctctagttaccttcctagtgtaggaagtaaacttttttcaggtctgacatgtctgaatgaatctttattttgtctttatatgtaattgattggactgtatatagatttttagggtgggagtgattttcctacagaaatctgaaagcatcacattattgtcttcttgcttttggcatttctgttgagaagtttgatgccattctaattgtttaacctttgtttgtcacctgtttttgtttttatatttgtctgtctgtcttatatcagaagtttttaggagcgtctctttagccttgatgttcaggtggtatgagtttatgtgtgtgtttttttcatttgttaatactggatacatagtaaacacttttaatttgcaactccttttctacagttttggaaatgctcttgaactatgtttttgattattttccccattttcttttaatagttccttctagaccttttggtttttagatattggattgcttatgttgatcttttcatttttcttccattttcattctctttggattttttggttttaatttatgggagattttctcaactttattttccaatctatttattaatttaaagagaactagcatcatgtttttaatttctatgtgcttgtttttgttgtttgaatattttaaataaatgttcatttcttattgcagtatcttctgtactctttgaggatagaaatcattattattattattatttgaagttttcttctgctcctggctttgtctgtttaccccatgttccttttattatgttttaaaataatatctgcctgtcacatttgtgatttccatctaatatttaacaatccttcatattgcagaatgaagtacaaaataactgaaacctctgtgtgaggttggaacttgttgattgtaggggaattggacacaattcatttttggtttgaggataatcgattatcagtgtcatgtttcctttttcttgagcttgctcgtttcagagagaaagccgtccatttccttcttgaggtttctaagcctggtacttagtaaaggaagggtagatctcattatccagtatgtgtatgccatatagattctaagataattccccccttttagcatatggttgtatctcatattccttagttgagagtcctcctggtttaacctctccaaagtaaaccctttagtcttctgccaggtgagtgtcaggtagttactgggctgcgtggattaaaggagaggatcctacatggattaagaaaaacgatctgtagtcactagataaaattttagtcatgcctcatctttttagcctcatctgcatccctgccttcagagcttcctggcctctttttaattcttatatttctggggcttattgcaggatctatttgcttattagcttaattacccacaggcacttttctctgttctactaaggctactcattgctacttgttcatcagatatccatctttcaaaatttagatgatagctcttgcttgtttgagagcggcctatttggctcttgtctttttattttcgtttctttgttagtttagcgccttaaaataatttcttaatagtcttttggtggacttcagtgggggaacagaagtaatcatatggtttgactccttaatcttttacttccacagagatatacagatcattctcattagttcatcatttaatatgtacatcataactacagaagtgatcataagctgactactgaacactagaaagttgacactgagggagaggtctcagtgagtcttaaagaattatagcgggcaagaaggttggtggaaaaagaattagggttagcctgggcaccatagtgagaccctgtctctacaaaaaaaaaacaggtgtgatagagtacatgcctgtagtcccagctacccaggaggctgagatgggaggatcacttgagcccaggagctcgatattacagtgagctatgattgcactactgcactccagcctgggcaacagagtgagactctgtctcttaaaaaaaagaaaaaaaaataggtttaatggtgcaccacaggactaagattatgtgttaggagttgatatttttcagaaaagtactaggaggatgatatgatttggctgtgtccctgcacagatctcatcttgatttatagttcccataattcccacatgtcacgggagatacctggtgggaggtaattgaatcatggggggtggttaccctcatgctgttcttgtggtagtgagttctagagggacgtgatggtaggtaattgaatcatggaggtggttaccttcatgctgttcttgtgatagtgagtgagttctcaggagatctgatagttttataagcagtttttccccctttgcttagctcttctccctcctgctgcattgtgaagaggattagtttgtttccccttctgtgatggccttcccagctatgtagaactgtgagtcaatcaaacctcttttctttataaattacccagtcttgggtatttcttcatagcagcatgagaatggactcatacagcaaattgataccagtagggtagggtgctgctataaggatacctgaaaatttggaagctactttggaactgggtaacagacagagattggaaaagtttagaggactcagaagaagacaggaaaatgtgggaaagtttggaacttcctagagctttggaaggctcacaggacaggaagatctgggaaagtttggaacttcctagagacttgttgagtggctttgactaaaatgctgacagtgatatggacaatgaagtctgggttgaggtggtctcagatggagatgaggaacttgttgggaactggagaaaagttaactcttgctgtgctttagtaaagagactggtggctttttgctcctgccctggagatctgtggaactttgaacttgagagagatgatttggggtatctggcagaagaaatttctaagtggcaaagcattcaagagtaggcagaacataaaagtttggaaaatatgcagcctgattatgcgatagaaaagaaaaacccggctggacacgatggctcatgcctgtattcccagcactttgggaggctgaggtgggaagatcaaaagatcaggagatcgagaccatcctggctaacatggagaaacccttctctactaaaaatacaaaaattagtggggcatggtagcgcatgcctataatcccagctacttgggaggctgaggcaggagaatcgcttgaaccagggggtctgaggttgcagtgagctgagatcttgccactgcactccagcctggcgacagagtgagactccgtcaaaaaaaaaaaagaaaaaagaaaaaagaaaaacccattttctggggagaaagtgaagctggccacaaaaatttgcataagtaatgaggagcagaatgttaatcaccaagacaatggggaaaatgtctccagggcatgtcagagaccttcatgagagtccttcccatcacaggccaggaggtctaggagggaaaaatggttttgtgggctgggtgcagagtccagctcccttgctgtgtgcagccttagtactctgtccccgccattctagtcatgggcaaaaggggtcaaggtagagctcaggatgttgcttcagagggtgtaagcccccagctttgggaggttccacgtggtattggtcctgagagtacacagaagacaaaaattgaggtttgggaacctctgcttagatttcagaggatgtgtggaaatgcctggatgtcgactcagaagtctgctacaggggcagagccctcatggagaacctctgttagggcagtgtggaagggaaatgtgaggccagagcccccacacagagtccctactggggcactgcctactgggctgtgagaagagggccactgtcctccagaccccagaattgtagatccactgatatcttgcaccatgtggccggagaagctgcagacagtcaatgccagcctgtgaaagcagccaagagtgggagttgtaacctgcaaagccatagggacagagctgcccaaggctgtgggagcccatctcttgcaacagtgtgatctggatatgagacatggagtaaaaggagatcattttggaactttaagatttaatgactgccctattggattttagacttccatgggctgtaactcctttgttttggccaatttctcccatttggaatggatgtatttgcccagtgtctgtacccccattgtatctaggaagttacaggctcataggcaggaggaacttgctttgtctcagatgagactttggacttggagttttgagttaatgctgaaatgagttaagactttgggggagttttggaagggcatgagtgttttgaagcatgagaacatgggattttgggggggccagggtagaaggatatggtttggctgtgtctccacccaaatctcatcttgaattgtagttcccataatcctcatgtgttgtgggagggacccagtgggaggtagttggatcatggaggtggttaccctcatgctgttcttgtgatagtgagtgagttcttaggagatctgatggtgttataaggggcttttccccctttgcttggcacttctctctcctgccaccttgtgaagaaggacgtgtttgcttcccttccatcatgattgtaagtttcctgagccttcccagccacatggaactgtgactcaattaaacctctttcctttataaattacccagtctcgagtatttctttatagcagcatgaggatggactaatacagaggaggaaaataacagtgcattattctatatttaattttattataaaaattggtaattatttttagattattgtattgactgtgcagtataacttatatgtcaattgcagtaccttagggatacctctttccttcctctagtggactatgacaacaggatttgagtaaaggaataggtgaatactttataaagcattttttcaaatgtgggtattttcactatctttgtgattgtccttttgactcatgtcagctttctttacatcctacaaaagcattatactctctttctaaattaagttctgtataaagtttagccaagttctcagagttaagcacctggaacaataactacagttattttggcctccttaagtaacaataataaatagtgactagccttaagccactgtattacaaggtaaagaatgctgcctatatctgaagccacattttagcttatttgctctttttgtttcaccacattgcttccctaatagtaaatttcttttcacagtttctgagagaagtattcctgtgagtggtgccctgagttgtataatgtcaagactgtactcctttctgcctttctattgctcacatttggggcattttataatttcagtttgatggtagagtggaaagaaactacgattatttttactagctacttttctctatttgatatcaatgtctatcaagagatgaatataacttttatataaaaatcccttccttataaaaatctgagcttttagcactaaaaacaaattactttataaaaaacttttcttaaggagaaattatgacattatgttcttttagttgttaaaccaaatttaaaaatacttgagaaatgtaaagttaaaagtgtcaaactgtattcttgattgtagttgtctaaatcaaagtgctttatataggtatataagatataagaatcttttttttttttttttttttttttttgagacagagtcttgctcgttgcccagactggagtgcagtggtgtgatctcggctcactgcaacctctgcctcccaggctcaggcaatttttgtgcctcagcctcctgattagctggaattacaggtgcttgccaccatgcttggctaatttttatacttttagtatagatgtggtttctccacattggccaggctggtcttaaactcctgacctcaagtgatcctcctgccttggcctcccaaagtgttgggattacaggcgtgagccaccgcgcctggccaagattgttatcagaagatgtttcagataacttatgataagagtcttatatataacatgtatgagatattaagaaatacttattatttatgattcaaggtagagtattaagttttggaaactgtaaaagaagccgtgttataaaataattctaaagaaactcatttggtctatccatattcttttgctcttgtatataccggaaactaattcagatttttggttctgaacaccatcaacgactctttagagaatcttttagtagctcttgtttgctgactactatataggtttcctgtatttcttttgaaaaaattggtattgaatgagagtttgacccttaaggcttgagagccaggggagggaaggctattattaagttctgtttctctctcatcatctaacatagtgattggaacagggtaagttatctattgattatagctccctgcaaccacagtagatgttaaatagagtagctcagcatcctttgttataaagaaaaatgagatccaggctttgccactttctgacttgggcctttgcaaaatccttatttctccaatccttttttaaatatatatatagaatgaaaatagtaatagctcctaaggattattttgtgtttgccgaataaatgaaataaactaggcatcatgcatggcactcagtaagtgctcagtgcatgttaagtgctatgattactattattgatactactgctgctgcttttattgctgctgctgctgctaccactaactactactactactactactactactactactactactactactactactacgatgatgattgtattagcatttttggcatcatttaattttctgagatattaaaatttcctgagacatgaattttgagaatctgttaaaaatgctttaaaatgcataaatatacagcattttagataccatttcataggtgtaatgaactctttaaagtgtgctctagaccataggtttagaactccttctcagaggataatggataccacttcaaatggacacaattcaggtggcaaatattggaaaatagcaaccaattagtacacaattatataaagacaaaatacaaattagcaaattgatagctccgagtattagtccgttcgcatactgctgtaaagaactgcctgagactgggtaatttaaaaaggaaagacacttgattgactcacagttccacatggctagggagggctcaggaaacttacaattatggcagaatgcgaaggggaagcaagtaccttcttcacatggtggcaggagagagaattgccaacgaatgaggaagtgccatgctttaaaaaccgttagatcttgtgagaactccctcactatcatgagaacagcatgagggaaactgctcccataatccagttacttcccacctggttcttcccttaaaaccttgggattataattcaacatggggtttgggtggggacacaaagctaaacaatatcataagggttgatttgggacaaggtatttctcaggataacattctctaaccatttgcaaatcatttaatgtgcttgttaaatgcagaattctgggccatagctcaggatgactgaatcataatttctttgagagattatgagtcttcttgaataccctagagtttaaagtcaaggattttagaataatgtttaatacaactatcatagaaagtgtatgatcttcttaattattcatacatagttaaagaagcttcaaaaataaaggatggaattatttaaccaaagtgtggaaagggaaaaagaagcaaaattacgttggtgggttttcatgaataattggcaaaatgagtgataaagtcttctgtgatggaatcagattgtgttaaacaccctagatctttcacatagcaactgttgtcctctgggcaaaaattagttaccttccctaatctattgcatcctcaatctgtaaagtgaagataataataatatctataatataggcctgttgtaaggactgaatgagataatgtacataacacatacttaagtcctcagtaaatgttaattgattagagttaattgtcattatcatcatcatcatcactatcatcaccattttagtggtggttgtccatactgtcagtataatattcttaaggtttctttgcctgtataattctcacctacccttaaggatcaaaatgaggttctcccttttgattaagttttccaaccatttatttatgggaattattaccttctgtgcttttatatcctttagcaagtagtacataataaagatgttaatatctactttttggttaatttataaaaatttatttgcttcctttttatctatacagagcatgtgaattttatttataagctattgtattttaacacaggaattatttgagctacaggttgagtgaccccctactctgaaaattcaaaatctgaaatgttctaaaatctgaaactttttgagagccaatattgactctcaaaggaaatgttcattggagcacttttgatttttgattttcagaatggggatgctctactgttaagtatataatacaaatattccaaaattcagcaaaatccaaaattcaggacacttctgctcccaagtattttggataagggatcctcaacctgtattttgtttctgtttcctcatttcacctgaccaaaatatttcagagaatttgtttactcaggtagttttttttttttttttttgagatggagtctctctctgtcgctaggctggagtgcagtggtgcgacctctgctcactgcaacctctgcctcccgggttcaggtgattctcctgcctcagcctcccgagcagctcggaccacaggcgcatgccaccacgcccagctaatttttgtactttttttttttttagtagagatggggtttcaccatgttgaccaggatggtctcgatctcttgacctcgtgatccgcttgcctaggcctgccaaagtgctgggattacaggcgtgagtcaccgcgcccagccttgcttgggtagttttatgtttaaatgtctccacctaggccgggcctggtggtgcacgcctgtaatcctagcactttggaaggctgagttgggtggatcacctgaggtcaggagttcaagaccagcctggccaacatgctgaaaccgcgtctctactaaaaatacaaaaattagccaggctggtggaatgcgcccgtaatcccaactactagggagtctgaggaaggagaattgcttgaacccgggaggcagagcttgcagagcttgcagtgagctgagattgcaccactgcactccagcctgggtgacagagtgagactctgtctcaaaaaaaaataaaaaataaaaaataaagtcttcgcctaaattaaacttgactttataagttaaatttgtttcaaaaagaaaaatcttattgttttctaaaaccaaatatgatttttaaaattatttcttgttttttttaaaaagtatttgtgcatttacttttatttcttgagcttgactaatcaagaattgaatgcataagtatagttatgagagttcagcccatttattttaaatttgcatcctttcacctctgaaatactaaactatgaaacctaacacaaatactgtaagaacatctgaggtagacagttagagtataattaagtttaaatgccttggtgaaggaatataaaaattatttaaattcaatcggctagtacatttgcagttttcttttattaggtgtgaaatctaagaatcccctgccaactcttgagggctcaatccagaatgttgaattgaagtactgcagcacatcattggtcaaatgtgcctctgggaccatgggatcaataaaaatttgtgccaaagccccaggtatgtgcagctggaccgtgtaaaactttattgcctgtataggagaattggccttgcgttttacaaggagcgttactgaaacaagaatttactcactgttgctatgaatcagacgttttaaatttttacttagaaatttttctaattgtgccaggatggtacttcttgactttaacaaatttttatttagggaaaaatacttagttttatgaatggttatgagggagaaaaattaaaggaatgtttattatactttttgggggaataggaggtgtatatatatgtatataatatgacacttaaaattaaattaaaaagttgttattgtaatataattaaataggagacccagttgtttttaaattttggttgtaaatgactttaccttcctaccaatattttatttcataatatattttaaaaaccatttgtgatttttttcagtgcaaactaaatttaaggtaagtttataaaagtccagatttcatttaatttttagaagacagtgtgtttagttgtttccttttataagcttttctggacatgttctgcattcattagcaaatatgaaaacttaagagttaaaaatgctttacattttatgagactcagtataattaaatgtatagctaatattatcaaataaagttgaaatgttatattatggtgttagtatattttaaaatcaaacattctcaagtgactcatgttttatttttattattgttttataaatatttcttttcagttgatagtggaaaagagaagttgattcccttgcttcagggtccttctgacactaaagaccttcatagcaccaagtggctcaatgagagtagaaagccagagtctctcttagctccagatttgatggccttcacaatccaagttccacaatatattgactactgccacaattccggtaagtacaaacctatcattattcccttgttttgcttttttttttttttttttccagaaaggcttttaaaattggtatatatttttttttttttaggtatttttgtcaattggcttactctgcagttgtgctttttcaaaattcaaatgaagaatttttgtatcacttttgttaattgaaatgtgtttataaataatgattttatttatatgagagaatttagctgtgtgtatagtggttaacttcagattcgtatatataaggaacaactgagttttaaaatatagcatatcattataatgcatattttcttgagatagtagcactttgtaacccaagtttgtcatgtgtaaattggtgtttttaccttctgtaattttttaggaatgaaaagatttgatggtagaactgagaagaaaatctcagaggtcattatctcatttcttagagttttatttttttctggtagcactttgaatagaatcgatttcattttattcaacactgtaatagcagagctatacctctcatgttgagagaaggtatcagaaggatcaatgaagactgagaaaagaaaaatgtatgataggtagagatcactatcagccatgaattcacttagccagtatgtggttagcaaagtcagggtgttcagtcaatgaagctagcaacgtgatagtaatatagacatttgttttaaaagatacgtggtccacattttctctctagaagtaactggccagtgagtagtttcaaatagctgctttagagtagagcttcattaacattattcaacaagtactgtagcttatagaaagtatgttcagcactagtatgttcaagtggaaactatgaaaagatttgcaactaactgagcagagactatgtagaggtaaatattgaataaagcagtgcacaaatgaatatatacagggacacaaaacatttgaaagatgagtatattatgataatatttgcagttgagtggtatccacattgaaaactggaaattagtatttgaaaggtgagtctaaggatgctgtctgtcagcatgcttcaaaggacagcacacctcaaaaataagatttcagcctggtaagaatgggtacagaaccataaagaatgaatgatcagaggatggctccagatccaaagtagggttgtccctatagagaaaagattttaccaatcttttaagacagggattggtaaatactttcttaaagggcctgacagctaatattttagggtttatggcccatacagtctctgtctcaactgtttctgctgttttagcacaaaaatagctacagacaaaacttaaatgaatggacgtgactgtgtttcaataaagctttatttataaaagcaggaagtgggccagatttggcctatgtggtttgtctaacatggttataagaagaaggaattggtggataaatatcatgactttgttaatgcctatttaatcatgttccttaaatatattgtttagtaaacttctttatagaattacccatatagtaatttttgttttcaaataataaacttaagatgatactaaaatgaccagaccattcagttacaattttgatacctaagaagagattaatctttctagaatcttgccacttgttcttgagttggacaggaactcttaatatttgttttaccacatatacaatgaaaataaattaataagttgagtgtatttaaataatctgttcttcaacaatatattaccttttataatttaaatgcatttctagggtcacaaaattttatttttgtttttaactttttatatagctctaaaagtaaagtggtataagaaaaattatctgtgacacctataatatttataaagttttaattttttcttgctgttaaggaaattcacctaatctgcaacattagtgttatggatagtagtatgtttatggatttgtgtgtaaaattttaatgtgatcatgtatttaatgctttgaaaatattcctttgggtatgttttgaacctaaaatgtaatatattttaacttaaaactacattcacatagtttatttatggtatttttaaatttaaatttttcatccaccttacaactgccacccacattcatggcttaggtatttatgatatggtttagagagctcataagtactatttttatgccagttttaaaataatttgaattaatcttatgttcttgtaacaagatttaatttgggtgtatatgtatatatgtgagtatgattgatgttatagacaagtcataagtaaatcttaaatgaaaaaatcaaaattccttaacagtccttcaagactttacaaaaatattatactttcagcaactactttcctgaccactgtatctaaatttctctctctgtctcctacacacatattgacacttcttacttatttttctacactcctttagttttccttagtacttatcagaatctaccatactatatatgttactgatttatattgttgattgtttcccctgctattagaattttatgcttcatttgggcaggacgttttgtctctttttggtcactactgtgttcccagcatctagaccaatacctggcacataagctaacaataaatacttattgaatgaataagcaagtaactgatgattacatttacttttctttgctttttgaagttgaagtatctaatggaatagagacaggaatctttctggaggcttaagggaagaaaaagatgttaggtggttaaatcttttaggtgaacagttaaagggaatcatgagtggtctctgcttgtgttttcagaaacagatagatgtcccggtgaggttgttaatgaacttttcccatggtcttatagaatttgaatgatgatcatactaactggctttttttgggtcatggcatgatgtgtggaagacagctgcccttgtgcatatactctcaaattgagggggatgggtggttaaatgggaccagcaaatgttgcagatgttacgtaaaagtcaattaggaagtgagttttgagaggagcttattacttaggcagccttttgactgtgatttgagaatgtgagggaatggacagctttattaatggggatttggaattatgacagagagaaatattaatggtattagtaaaactcattataaaaacagtactttacaattaaaatgtcacatttgtgtaaattgttttatttgcttacaaatcaaaactgttttaggcagagaaaatattatttgtgtcttgcagaggaggaaatagatgcctagaagttcaatgacttgtccaattgcctagcaagtcagtctttgaactagaacttggaacttctaactatacaacattttcccaccatgttgggtgttgggctgtttatcattttctcttttaaccttagaatccacctcactaaacactgtatccttcagtcttaaaagttcctaacgtaacggatctccttttttactttatattaagcactgtcaaaagagccacactgtcatgatcttacagcatttctttgtctttgaagtctcagcaattccctttacacttttcccacttccttccttgattgcattctgcacttgactaactctgattaacagcaaaggagctgaaggctcttattagaatacagtatgccagcacacattctgtatttatggttatttttcaggggaaccatttaatgacacatttcttaggtttgtgtagatacaacaggtcacatagagaaatagatgcttctctggttcctttgtaggtagaagcacttggtgactataactgacataattaaaacatttaaaaataggttctgcaggtgcagtggctcatccctgtaatcccagcactttgggagggctgaggtggaagcatcacttgagcctgggaggcagaggttgcggtgagccaagatcacgtactgcactgtagcctgggtgacagaacgcaaccctgtctcaaaaataaataaaaataaaaatgaggttctaaatattttcttcccttattttttattattattattttttagacagaacgttgcccaggctggagtgcagtgggcgcgatctcagctcactgcaacctccgcttcctgggttcaaatgattctcatgccttacagaggcgcaccaccacacctggctaatttttgtatttttagtaaagatggggtttcaccatgctggtcaggctgctcttgaactcctggcctcacgtaatccacccgccttggcctcccaaagtgcttgagattacaggcatgagccactgtgcccagactcccttgtctttttaatatagactttggctcttcttatgctatattttgcctatgattcatagcaggttctgcttgctaaagagttctgagtctttgttaatcatggtattaatgtgtaaataaattttggagtgtctgctatttaggaatataaaatgaccatgaattctatcagcttagaatcaaaagaatttaggccatcatttcaatttctgttttttcttttgatatggagtctcgtactgtcgcccaggctggagtgcagtggcgcgatcttggctcactgcaacctccgcctcccaggttcatgccattctcctgcctcagcctcccaagtagctgggactacaggcacctgttaccatgcccggctaattttttgtatttttagtagagacagggtttcactgtgttagccaggaaggtctcgatctcctgacctcgtgatccacctgcctctgcctgccaaagtcctgggattacaggcgtaagccatcgcaccaggcccatcatttcaatttctgagccagtgttaagagttctatttacatgtctcctgctctctctttgctctggctctgctggccttttttgatgttctctgtggtggttatgtatttacatatactgtttttttctgtctaggattctcacaaccatccttaccctttttatacctgtttatttccagctcagtctcaagatctcagctcaactactgtttctccaaggaagccttctgtgactctgccttttccctactccctcccaagccactcaatttaattaagtacctctcttacattctttcatagctgttaagacggtatatatttatatatgtccttaccacttgacagtaagttccatgagggcagaattaatcactggctgcttaccattttatctccagggcctatcattgatgaatgcacaaagaatgcatgagaaatcgtttgttgaatgaatgaataaatgaatgaacatttatgacagatgttcaagggtataaatttgacagataaataatcagttcttgatacatgttagccgccttttcttttctctatttctgtttcttcctcctcttccttttccttctgcatatatctaccactagagaaaatatctaccaatatctttctctgtaagacagttctaattactattagattatttattcactggactatacctcccatttcctggtctgattttattcttataaatgacatgaaataatatatcagcctgaaatatacctgacaacacatattatcttacctttcttagctttttttcacccttcctttcatttggtattcatcctctttagtctccagcatttactgctatggttgatcataccctttctattcaatccttagtctcttttggcttctagatgttcagagacaagtctctatagcagtggtcctcaactgttttggcgccagggacctgcttcatggaagacaatttttcaatagacttgggtggtgggggatggtttccagataatactcttccaactcagatcatcaggcattagattgtcataaggaatgtgcaagctagatccctcgcgtgcacatttcacaacaggctttgtgctcctatgagcatctaatgctgctgctgatctgacaggaggcagagctcaggcagtaattcttgcttgcctgcccactcctcacctcctgctgtgtggcccagttcctaacaggccacggactagtacaggtccatggcccaggggttggggaccgctgatcgataggtcttttttgtttttgcacttcttgcgaatggaggcactgactgccctttgttctggactgtctattcagagatgttcttatagtgaacagccttggaagacaagtatcatgtctcattctggagcaaagagaaagcatgcttcctgttataaaacatttggttccttaacttcgggttcatctcctgttatgtaattcactgcatgtacaggcagccatctgaacaaacgtgcacatcatcacctctgtgagacttgtgggcaaagggaactgatgcaaatatgttgatactggtgttgctccctgtgcgataagtaataaagtccttatctgtgacttgggatccttgtcttctgcagccttcatgaaactgtggtagcgtatgatcttaggtccctgacaattcttgacaccagaacaatgtcgtttcttggttttccttgctttgttcccctcctcgaagatgtttctttcttctgttccttaaatgtaggttgttaccaagattatgttattgaccctgtctttgtatctgaatgatctaatcaatacatctgttttcagcaaccaaccataagtttatatctttctgtccatttttttttcttttgagatctggactgcaaatttcagctgcttcttaaatattttctttggatattttagtggtgcctaacacattcaaaactaaactcagtataattttttattccctatttcatacttcattattcactctttcagttaataatggcactatttccctcttaatactgtcaatttcagcactaccttgattctgccttctttcttccctgcacatggttgatgttttacaaaagcctccaccaccccaccaattaaatatcctaggcaaaacatcataaatttatttcagtaattttctatatgatttgtcttcagattgtcaaactgactacttccactacatgtttgaaaatatcttctttaaaatgttaactccaaaatttaacacagtcttccacataccacaaagtacaatatatatacttctcagatttgtatagggaacttctattcagttgctatttgtcttgagcttgtatgctacttggaaaccgtggatctttttcacacgaactactcttaagacatttttacatattttatatgtctacattagtttatgaacctacttggaaagctttatacttatttctatgaaatttcacctaattgattttggtccaccattaatgaagatgataccttttaaagtatctgcttagctgtagtcacttgtgcaattcagatgcacatgctatttttgcttttaatataatggaactaaaaataacgttttttactaaggtaagaaaaatagatttatgtgattatgatgttattttaaaataatttaaaataagtgttcctcttaacgtatctttaaatgtaatgccaatgtaaaccagtctttattatcttgtataatttgtttcagaattaagtagtataaattttttaactttaccaaattgtgataaattaaaaataatttaaaattttacccatcgcacatgggaaacttttggtcattgttattggaaaggaaagccacaattacaactctaatctctgtaaattaactgttacattgggaggtagttctttgtcttgattaaaacataccagcaaacagacacactcttttggttcaccatttggagttggttggttagaatatattgtttaggagttttaaaaatggagacagtattttatattgtaagttttaatttgtagggaatgtcttttttggtttcaaaaaattctgctcctaatgtagaaataagtgaattgccttgaagttatatgtttagtatttttgacagaacatatgagtaagaatgcttatatattgtagcaattaaagacaattcacatttgtggtttgggcataaatgtgtaaaaattatacccatctatcttattacatttcctctttcctccctgaggacgttactatgtattttatctgtaattgttgccagttttctatcacgttcccactgggcttttggtgcaaaaaatcttatcctcttgatgacagagcttgcctgaatgatttcatgctcctagcatttttgttcacgggaattaggggcaaaatgtaactacagctgaacagagcgtctatttttgtaattttggagtttaggctctgttattggaactaaatgaagagatgcaggtgttctccagtccaagccctttgggagttttgatggtagatgcttgaaaagaaaatgcatgtgtttccacagtcaaacagcagctgtgagacaaggatttatgcttttctcagaactttgggatttcaaaatgttacatttaatcacaagcccagaaaggggagcaaatgttaaagatgttacgcataaaagtaagtttactgatttctttaccatacgaactagttgtgggaacataggaacaaagtactttttaatcataatgcaaacaatttctaaaggattatgataattgtaaggacattgccttttgaaaatgttacatttgtagtgcagagaatttttttatcctactaatttcctaaaatatattgatattttttcccgttaagagatgcaaacacatacacacacaagacgaaaggtgtggtaaactatttgccatatgcattttaatttttttccccaaaaagtttaataaatatcttattgtaaaaacaatattttcaagtactagaaatgtcaagttctagctaggatactaactaagggaatttatagatatttaaatacaggtgtatatttaaatgtttacacaaaacaaagcatatgtatatgtttaaaatattttttcttttttcagatcatgaaattactttgtgttagttgattttcaaatttatctttattaaagcaccaccttgcagtatttctttgccattctcctatttttattgctctacttttttagcataatcattcatttattcatctaacaagtatttattgcctattttttgtgcgtagaactataacgatgcatcaaagtctctacagtgaatcaacttctaatgaggagtaagcatataaacaactacagctgaataaatgaatgatataaaggcttattttttgggttcagcttcatccattataaattatgttactttgagcaagtaaacctttctgagtattggtttctttttttctttacttttttttttgagatagaatctcactctgtcatccaggaaggagtgcagtggtgcttgcatcctctacctcctgggcccaagagatcctcctccctcagtctcctgaatagctatgactacaggcatgagctgccacacctggctaaatttgtgtgtgtgtgtgtgtttttgtagagacagagtcccactatgttgcccaggttggtcttgaactcctacgttcaagcgatctttccaccttggcctcccaaagtgctgggcttataggcgtgagccacagcacctggcctagtgttggtttgtcacctataaaatggagatactcttatctgcttactaagattgttgtgaagattaaatactgtatcctcaagtacattgtaaactttaaaacataatgtggattttaagtattaattattcttttcacaatagtaccctatattaaccagtgattgaaaatgtaaggtttttctgagtcatttcttttccttccttaatctcaacatcccagttaatggaatccactttaaattttttctcaaggtaaaaatttgcaaacctatgattatgcatttctgaagctaggagcaaatcctttacctagtttcgttattctccttccacattgaaatgtaccctggacgctatgatgttaggagtcaggaacagttgcaatagcaacaggaaattactttgcttgcttcctttgaaaggtcccagattctggaaggatgccagagggagaaatcccttgagccttaagggtaaccagtttccctcatttatatagcacaaggtcaaattttttgcattttattactgcttgtatagtaaaagtaaactggtattcagagtaaatagtagcttcattagtaagtagtaaattagtatacaaaaagtattcgggttgtatactgggctgcaggtgaacttcactagaaaatacggactatctcataatttgtttaaagtatgttttatatggatcaaaaaggtaccagtattactttattttctacttagaaaataatatacattttctatgtgagtttttatttttgcaactcatagcttttgtgtttaagacccaatgacattagccttgtgatcctgtgcagattttgaagttggctgtatagtagctttcatataggccaaaagaggagttgctttataaaacacttacgggtgaaattcacatcaatctttgctacctgccccttctcctagttgttctataccctctagaaaaaacctcattctactgacagcctttgcattccttttattcagttcagtatacatgggagtcattcttataccattgcattgttttgtaaataagtgagactcagttgtctgttaatgtgtgagagtttaagtgttttactgaggatatttctgttttattttcacctccctctgacttttgcccttcctcctccccatccctttcctctcccctcccttcccaattaattactcccttctaagcacaaccatagcacttttgctgtatcatgctgcaaatagtcttaactatttataggattccttccccatgaagttgggagttcttaacagcagggaaccataactagtgtatgataggtattcagtaaatgtaggctggtccaaaggaaattatttttgccatttgggcatagccctattgttcgcaggtacatatttcatttctgaattgctctatggggaaaaatgtagtctggcttcggtctgttaaagaataatttttaaatgtaaaatcataactctcatatagaaataagacaagtgctaaagattttatttaactcatcattaatgagagaaccaggcatatgttacaactagatcaaaggagaatttaaaaaacagaggcatttgttgatcagtaatatcaaaatagatttggaaatgaacaaactggcttttcccttaatggggaaatgagatcaattgaacttctacctgacagaatttgcgtaccttcagtcaataattattttgcattgctatcagttatctataatttactgatttgtaaaatagtgtaaaggcaatgaaaggtgcagagtaacatagagtcagaatcagataacctgcaagggtgtgcttttaaaaacacagagctctacattgaagcacaagttatttcctaagaggcttgctaaattccagatggctaggatatttctagctatgggtggtttaaatatagaggcagatcagaaataattttgtgaaggtttagtgcatggtgggaaaattaaagagaaatgataccaccggcagagggcagtaatgaaataacagttttttgaagacaaaggaaatattgattgttgataattctgggataattctgttgaccttaacttgagttttacttttcaaatattgccgtactaggttcctttcagccagctgctttgccaatacctggaacgtgccagaataaggctcattttggttttgttttaggctttgttaatgaagtaaataaataaaatattctaacctggttttagttaagtaaataatgtgttctaacttctaagtactttttctgtatggcagatatttgagtatctgttgtagattaggtgttgctttaggtattaaggagatatatgtgtgtgtgtatctatctgtctgtctatctatctatctatctatctatctatctatctatctatctatctatctatctctccctccgtactgtatagatagatagatacatctccttatctatgatgagttatgatatgatctatgatagatggatatatgtagctatctacacacatgagagtttccaagcctcaccaaagtaacattctgttgattatgatattttaattttagtagttaatttattctattttttatgagaataaaacacttaatatagtattatttaaactatcagaagtctttctttgaatgtaataatgacatcatctaatttccactaaaagataaaaatctaaaatattgtgaaaatatctatctggaaatatatgatagccaaagttatataaaacttagttatagataaataataaaaatgcaaatacaccataggaaaatggccaaaggggacaaaagtaagaagcacaaatgatcaaaacacataaaaaattcaaattaacaagtagtcaaagaaatcgacattaaaacactaaggaacatttttttacctgtgaaattgataaatgtttactaaatgataaaacaaagctgaggaatttataatgagatgagtatgtccataaaagtctggcaggtgtatgaattagtacagagcctctaaaaatcaatttagcgaagtttatgaagaatttaagagtggttatcttttataatcccacttctaaaactatatcccaagtgagtaatccaagatgcgtttgaaagacttatatttgaagtataagggtatttatgtcagcttatttatgataatcacaaattatctttgttgtctaatagtaggcaaattacctaataaatcagtatattcctagaaggatattgatgtcaaaggaaaatgttcatattaaaagcttgtgtgaaaaaataaaagtataaacctacatataagattccagttttgtaaaatttcttcagtatatacatatgaatatatgcatgcatgtatatttatgtattcataaaaattacttttaatagtgattaccagtgcttaatgggattatgggtcaactcccagtcatacttttactcttctatgttttttgatattttctgcaaacataatagatattaaaaaatatttcttctccagaattacttattttcaaccaattatttagagagaattatggttatttggctcacacatagcattcttgcacacttaattcttatataacctttaataatgaaatacaatttcatttttaaagaatatatataccctgaaagtcacagagtctatagctcaatttttgaagatgctttgaggggcaagtgggaggggtctcaatatgtatgtgaataaaataccaaattttaagatatcataatttacatttctctttgaatagttttagtctagtgactaaaatatttaaaataactttatttttctgataattgttttctaattataaataaaatgtgtcttctttttgatgtatagttggaattttatcattagtcaactatcaggtatagtacaaatcaaaagaaccttcaatgacttatgatccagcatccagatattcacttgaaaaatagctctttgactatttgcatgtattttgacataggaacaaagatattgattgtcatagttaaactccaagttcagctgggtgtggtagttcatgcctataatctcagcactttgggaggctgaggtggaaggatcacttgagtccaggagtttgagaccagcctggacaacatagtgagacccctgcctctatgaatgaatgaatgaatgaatgaatgaatgaaagaaggaaggaaggaaggaaagaaagaaagaaaaagaaagaaagaaagggaaatcagggtcaactcatgaaatctttttttgttaaaccttcgataaagttgaaattttccaaattcttaatggaaactaatggaagttaatactctagataatgatcttacaggaagagttaagaacaatagtaaatttgaataatatctaaaatcatctaacttcaggtaaaataggtttagttaggagaatgctatatatacttctgtagagacactatcaaagtatttttcagtgtatctataataggacattagagtttgatgatattgccgttcttttttgtttttaccctcacttccagtcagttcctgtcttcttgatttgggctttatttagaattattagctatggttagtgttactttgggctcaagttgagaactagaaagaacatttccttgagatagctggatgagttgacagagatacaggaaatgtcaagaatctaaagacgattcatttctatgtgggcatgagaatttctgaaataatgagctgtagttgacgaaaagcaagcagagcttagtgaataatcttttcaggaagaaagaaggtgaccaggccaaaatgtatcacctctgcagggtgataaatagccactgaatggagaggaaagagtgaaggaggaacaggcaatattaaagtaagttgctggtaagtttttaaaaaatcagtttgatattgttgaatcattaatcatcagttatcctaaaaacaagatttattataatgacttatcctgtgtagaaaaatacatctattttgagtgggagactttcaagatcatttctagtccagaagaaaagaaaaggcaaacattttatttgggcaagtgtcattagagttaagcatctagtgagtggaggaggtaagactgactcttgttgtctggagttctttttattatgtatattactttaaatggccattttcaggtgaccatgtagttacctgtattcattcaacacatattttcttggtgctggaaccttatgatataaagatgaacgagacccttttatctcttattaatgagcttatatgtagttcattgatggagacgtacaggtaagtagacatttaaaatgtagtttattgtggcactattcacaatagcaaagacttggaaccaacccaaatgtccatcaatgatagactggattaagaaaatgtggcacatatacaccatggaatactatgcagccatagaaaatgatgaattcatgtcctttgtggggacatggatgaagctggaaaccatcattctcagcaaactaacgcaagaacaaaaaaccaaacactgcatgttctcactcataggtgggaattgaacgatgagaacacttggacacaggaaggggaacatcacacactggggcctgtcatggggtgcggggagagggaagggatagcattaggagatatacctaatgtaaatgacgagttaatgggtgcagcacaccaacatggcacatgtatacatatgtaacaaacctgcacgttgtacacatgtaccctagaacttaaagtataataataaaaaaaaaaaagaaaaaaaaggtagttcaaggaatgccacaaaacaaggtattatgaattcacattgaaagaaatccttaacccagtctttctgacttggaaaaggattcctggaataagtcatgtctaagatgagtccttaattaagggttggagaagaaacaattggtcaagtttggctaaactgtaaataatttctgtggatttgaagatttgaatgggatgggatcaatggtaatagtttgtgcctgataagataagaaagctccctcagattaaaacgggccttgaaagtcattttaaagggtttggactgagtgccaaaggaaatagttaaaaggctttttttatatttatgctttagaaactagcataggcagtagtgtggatgaggataaatgacaggaggccatgagaaaagttaggaatatgttgcagtgaaaaaatgctaatgtcaatggagagaattacacagatttgtggaatattaatgggttggaattacaggaggtgattaattgaatatgttggccaaaagaaagagcacagtaggcaagcacccaggatgtggatttgaagagctgggtggacaataaaatgccttttactgaaatgaggaacaaagaaacaagaaccaagttttctttagggtaatagaagcaatagatgtaataatactaatagttctttctacgtgccaggaattattctaagcattttacagagaacataggcagtttgaataaagaactcatattcttcaccattacgtgaaacagcacaggctatggagatttcagactctagataatttatgattcaattcattgaattctatttactttaatttattggctgctagctgcattctagaggctggtatagaaagttactcagtacagggccctggtcaagtagtctatatacacatacaactaattctaatttgactttcacaaatgatataattgattgggagagaagttctgctatccaaaaatagaggaaaaagagattaatttgaattgaagaagggaggactgaatgatattagaaagatctctcaaggaaggattgatatttaagccttgagtgataaaggattgcacatgagtggaaaattcttattttagcattgcaaatattttcaattagcttacattgttttcttttaaatggtaattattattggatgaagacaatattcccataaaagtaaaaaatatataattgttgttaaaaagtgtttagtacatatttgtggtaaggtaatttttcctctacagtatttcagaatattcagataagtataattaggaatcatatttaaaaattttaaaagattgtagaatataagattggattgttattgctgctttgttttctaagacaaatttttaaaatttggatgttgggattattagatttaatctaatttatgtgggtaagcttggagttaattattaagtagaacttgatttttagccttagaataacaaatgcagaagtgaagaaaacttttaattggatttgttgttaacaaagcatggcataagtatgcctcagccagcctgtgaaagggatgacttaacacaactgttgatgcatttagagtgaaacatctttatcaagttaatataagaagcagtcatgccctacttgaattactcatttataatagctgaacagcagcctgcatgtggactttgaaatcctgggaaaataagatgcctgcatacatccaaatgttgaaagcttttacccttcagcagctggaaaatgttgagctcttttgtcatctactaggtttttggccctcagggagatgtgatcaatttaattactgaccagctttatctattacttttaatgattatagtcgctgaagtaagcctctgcagtttgtagctgaaaagatcatgtttagatattatgttatttaaaatctataaaagttaaacacatggacctagatgtttctactttgctcaggtttatcccatatattgggatcactaaaaatagcaaataatttagatatcataaaaaataatttatccaccttaaatggaatctaaaaggggcacacaatataccccatatattgcagttcttgggtaaattttatatgttatatctatttttgtgcaactgtttgtaactttcctaagatacagacagtggtttattttgaatcagaactacttataaacacacaatgcaactaattatttgtgcttcttatttagcttcttttcactatctttttgatgactggtccaaaggggatttttagaaaatagcatggagtgaagactatactttcagggatcatttctatagtttgttactagagaagtttctctgaacgtgtaaagcaccatttaaagttcatatggagccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacgaagggctaatatccagaatctacaatgaactcaaacaaatttacaagaaaaaaacaaacaaccccatcaaaaagcgggtggacatgaacagacacttctcaaaagaagacatttatgcagccaaaaaatacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaaaacacatgcacacatatgtttattgcggcattattcacaatagcaaagacttggaaccaacccaaatgtccaacaatgatagactggattaagaaaatatggcacatatacatcatggaatactatgcagccataaaaaatgatgatttcatgtcctttgtagggacatggatgaaattggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagagatagcattgggagatatacctaatgctagatgacgagttagtgggtgcagcgcaccagcatggcacatgtatacatatgtaactaacctgcacaatgtgcacatgtaccctaaaacttaaagtataataaaaataaaataaaataaaataaaaataaaaaaagaaaatagcatggagtgatatggcatagctaagacaagatccctgttatatgaaggaagaaatgtgtctgtaacattaaagctgttactctggaattctaattctggatcttaatcttggtgtaaatcacttgagctcaatttgattgtttcttaatctgttaaatggttgcaatgccagatactgaatactgttgtgttgtccattgcataaagacacccttttaaagaggtcaccattcatgttgcaaactaagttaatttgtttattattattgctgttctcacaaattggtgtattatgacagtattctacagatcgaagtaaaaataaggatggcatcatgtggctggtggtggctgtggatgacattgatgatcctatgtttgactagtttctcctttttagttgatgtgttaaaaatatttgttggtattagaaaatgtaagagcttatcttcattgacaaacatttgatcatatatgtagatgcattatgctagtgacatactgagattttacagataaaataagcagtagaaaacagttagggagatatattggaaattaatttaaaaattgtctcttggtactaggtgataaaatgtcctaaaatttcaaaataaaaaagaagttttacatcattaatatgtatgatattttacttatataataactttatatacaggttaatgatacatctataaacagcctaaaggaaaaaagattaatgaaataagtatcttttgaaagaggttaagtaatggattttatgatcagaagggacttgttctaaagttgacagaagaatctaaagtggtcagaaactgtgttcaaataaaagctacagaacatatatgtatgtatgaaaactccttgacttatgatgttacagcttgataaatgctttgtaaatagaaaatattaagtagaaaatgtatttgatacatctaacctattgaacactatagcttagcctggactaccttaaatattctcagaacacttacattggccttcagttgggcaaaatcatctagcaacacagtgcactgtagagtacagattgtttacccttgtgatcactttctgccgctgcccagcatcacaagagagtagcatactgtatatcgctagtccaggaaaagatcaaaatcaaaatttgaagtagaaggccaggcgcaatggctcatccctataatcccagcactttggaggggaggtataaggattgcttgagcccaggaatttgaggccaacctaaacaacatagagagactctgtctctacaaagaataaatttaaaaaaattagctgggcatggtagcatgcccctgtagtcccagctacttgggaggctgagatggaaggagcacttgaactcaggaggtcaaggctgcagtgagctctgtttgcatcactccactccatcctgggcaatacagtgagaccctatctcaaaaaaacaaaaggaagtatagttcctatagtttctattgactgcatatggcttttgcaccatcataaagttgaaaaattttatgctgaaccattgtaagttggggaccatctgtacattatgtaaatattaattctaaaaatgagtttggagtttattcatttgccttttttgttacccttttaattatctatccaaatattacctgtgtacatataatttctgtgccagatcagggcaaggatgtgaagagcatttattgttctagaagctataaatttttaataaactttttttcactggaaataaggataatatctatgtaattaatgatagaaaaatattttggaagtactacatatttatatataggtaggacatatgctagattcttatttctaatattactacaatatgccattttttctaatacataaaatggaaacctggactgaatgtaaatttgaatgaatttttctagtatagttaaatctttctttactctaaaaacaagcaaaaccttatctgtgcatattgtgaatgcatatttatgcaaggatggtaattgctgtggtctgaatgtgtctcctaaaattcctatgttaaaacttaatcaccaatgtgataatattaggaagtgggtcctttatgaggtaattaagtcacaagggttggcccttgtgaatggaattagtgaccttataaaagaggttgaaggaagcactcatctttccttattgtccttctgccacgtgaggacatagctttcaggtctccatcttggaaacagagaccaggacttcaccagatagtaaacctgcaggcatcttgatcttggactccctaggttccagaactgtgagaaataaagttctaatatttatagattacacagtcttgagtattttgtcatagcagcacaaatgaactagaagagtgataaacaccaatttaagtataaatatttgtgtatttatatatatatatatgagggggagggattttttgaagacatctcgtgtactcatgtgaaatacatttctcaacaaattcagaaaatttgagactttagatgctaaaatgtaaaatgaaagtaaggtttttatagggtttatttgcttattgatctgaaattctgatgacaaaacttagtttagatttttctttttttcttatattgaaaccaagtgaaagattttgtttgaaattggctattgtttcattttaggcagccctttttgagatgcgcataggagctctgcattggtttttcactagctgttagaactttgttctttttaatgtcaacctcttaacagcctaaagtattaatccttgtaatcacatttgtaactttatattttggtgaaattaggaaacttgtcagctattttcttattaaaataatgttttttaaataattgttatatgaatcaactaggtctaagggtttgtgtaataagacatcattacttcatattgagtaatatgtaaaatcatgtgctaattcttttcttccttttttctttttacaaaatgaaaatgtcattttactgttctgataaatgcataatgcaaaaattcccatggaaagaaaaatattaagaagtgttagcaatctgaaactatgtgctagtggttagctagtgtttatgttttggtgaacatcgttttagacaattttctatgcaacgttagataaacatagaattgtacacgtatgattttgtacccatacattttcttctgtacctgcctttccactcaacagtgttttaaagccatctttctatgccactaaatacagtttttcttcctcattttaagtgacattgtagcatcctgttgttggctgtcttgaaattaattaatgtcttcttgctgggtaatacattattggtggatatttggatattgggatttttctaattttttaccaatagaaagaagggctgagttttgttatattcatctttttgagcttgcctgacagtaactttattaaaggcatgttttggtgcattattttgcccttgataaacattgtcaaaagtttattcttcaaatattagtgctaaataagtttaactacaaattttatgatgcagtggctaacttttcagagagttccagtgagtctttcttgtctatatcataattaatatacttttgtcggccgggtgcggtggcttgcgcctgtaatcccagcactttgcgaggccgaggtgggtggatcatctgaggtcaggagttcgagaccagcctgaccaatatggagaaaccccgtctctactaaaaacacaaaattaactgggtgtggtagcacatgcctgtaatcccagctacttaggaaggctgaggcaggagaatcacttgaacctgggaggcagaggttccggtgagccgagatggtgtcactgcactccagcctgggcaacaagagtgaaacttggtctcaaaataaataaattaattaattaaataaaataaaaataaaaaagatatacttttgtctgatagaaagattatcttggagatcgtcaagatgtcatataaataattcactcaatgacatgtaagtattttttcctagaaggttttaatgctttaattctactctcaagtatcttgtaaatcatttctttagtttcattatcccaacactgtttaagagaaagaggttagactttggagtcaggcaaacctgttttcagatacctatttgctttaactttcttcatgactttgggagttaattgtcttcccaagtgttattttttcatttgtaaaatttatttaaaaaattggcccccttacagggattgtttttaggattaaaggtagggaatatgaagagctagcacaaggccaaggagtgagtggcaggtgctcagaaagcagcacctctgctttgcagggatggtttttgatggtcagaaacactcttagagttagatgtgatctggagtttcagtcctgccacattccaaagagcgatcttggccaagttattccaccacttttttttttttttttttttttttttgagacagagtttcactcttgttgcccaggctggagtgcaatggcactatcttggctcactgcaacctcagcctcctgggttcaagcgattctcctgcctcagcctcctgagtagctgggattacaggcccccaccactacacccggctaattttttgtatttttagtagagacggggtttcaccatgttggccagtctggtcttgaactccttacctcaggtaatccactgcctcaggctcccaaagtgctggaattacaggtgtgagccactgtacccggccaagttattccaccgctttacgttttaatttcttcattaaaaagaatcagcacttaagttttgtaaggcttaagttaaattatgcacataaagtatgtagtgcagttttttggcaaatatttcttgtgttactactgatatcatttttaccagcagattaactccacatttaacatgaatttatattttagtttttttattgttgcaccatgctaaacttacagattttttttttttcctgtccatccttacattttaaaagtaaatttggccaggcacggtggctcatgcctgtaatcccagcactttgggagtctgaggcgggcagatcatgaggtcaggagttcgagaccagcttggccaacatggtgaaacccagtctctactaaaaatacaaaaattagctgagcgtggtggtgggcctctgtaattccagctacttgggaggctgaggcaggagaattgtttgaacctgggaggtggaggttgcagtgagccgtgatcgtgccattgctctccagccttagtgacagggcgaaactccatctcaacaacaaaaacaacaacaaagtaaatttatacttaacataaactgagtagcttgccttgttgtgttttgttatatgatcatataactactacctgattgtctaatgggaacatgtgccaaaagttctgtttacaagatcaaaccagtgtgtttctaaatctttgagtctgcctctctctaatcctttcctttgatattcttgcccatagctgtcttatttagacttatttaagcaaacttgtgtgtgtgtttgtgtgtacaccaggggtgagcacaacattttgaggttttcatatgtcctcatttgggaagccatctattgtctgcaatccccaaataccacttgggtcactttatctctgctttttgctatgttaatagcatatttggcattaatgtgcactttgataaacagcaggttacttattctaaataattttatgttagcttttgaaagcaaatagttaaaagaatatatatttctcaataaagcattggttgtaaatactgcaacagtatgcaattgcaacatggtaacattggtatgttgggtgtgttttctttttatatagacttctcaaccagcgagtagtagcttaaagttgttgctgtattccaagtcagtttgtaaccaaccctaatatgtgtttggctaagagtacaggtttccacgtccttacttgtttatccctttcagcctaggtatcatttttgaaggaggttttctgggagatatgatgaatcatcctgcattctcttcccagttccttttctttagttatccattcaagagagattgtctgcattactcttacagagctgggttttagcctcagctatatcatttattaggtgtttgtcattaatgtgctgctgtgtacctcaagtatcccactgtgaaataggaatattaataagtgttagcctacctcatagtgttattgggaaaaaatcagattatttaatatagtttttttttttttttttttggtaaaccaagttctgcacacataataaaaatattaacttttggcccggcatggtggcgtgtgcctgtaatcccagcactttggtgggtggctcgcttgagccccaggaatttgagaccagcttgggcaacatggtgaaaccccatctctacaaaaaaataccaaaattagttgggtgtggtgtgcatgcctgaagtcccagctacttggaaggctgacgtggaaggatcacttgagcctgagaggtcgaggctgcagtgagccatgagcatgcaattgcaccccagtctggataacagagcaagaccttgtttcaaaaaaaaaattttttttaacttttatttagggctcgttagtatcaggcactcttttaagagtcccatcttgttttctttctttctttttttttttttgactgagttttgctcttgttgcgtaggctacagtttaatggcgcaatctcggctcaccgcaacctccaccttccaggttcaagcaattctcctgccttagcctcccgagtagctgggattacaggcatgcaccaccactcccagctaatttatttttagtagagatggggtttctccatgttggtcaggctggtctccaactcctgacctcaggtgatctgcctgcctcggcctcccaaagtgctgggattacaggcgtgagccactgcacccagccaagagtcccatcttgttttatcttcgtagtaacttaatggaacgggagcttattcagtaaaaagttgaaagcagaaattgtagatgatatatcaaaggtatttatgtaagataaggcagaacttagagtccttgtttccatctaaatccaaagacaaattaatggatatacgtttgtgttttatgtttaaataaaatggttttgtttttgttttttaaatacagatggggtctcattatgttgcccaacctggtctcaaactcttgggctcaagagatccgtctgccttggcctccccaaatgctgggataacaggtgtgagccactgcacccaggctaaataaaatgtttagactgtaaatgtattctttcttgtgatttcttactttaactaatttttttcacccttcaactgaagcagtactcatagtgtcaaataagagagctctggagctccttatttcaatgatctctaatgggactcagtctaagaaaggaggggcatcagattttctgctgcacgaggctgttctgaagtcattattctagggtttgaagatacttacttttctggcccttacttgactcctccggccatagctccaaactgtctagccagattaccagggttggcttcagatgaacactttagtattttgatgctaaataccagtgataactataaatatttctcaacttatgatgtgtgttttgttttaataaatctactgtaagttggaaatactgtaagttgacaatgcatttaatatgcctaacctactgaacatcagcttggcttagcctaccttaaacattctcagaacacttaccttagcctattattgggcaaaatcttctaacacaaagcctattttatgatacagtattgaatatctcatgcaatttattgaatactctattgatttttttttttattaaagacagagtttcactctgtcacccaggctggagtgcagtggcaagatcttggctcactgcaacctccatctcctaggttcaagcaattctcctgcctcagcctgccaggtggctggcattacagggtatgccaccacacccagctgatttttatattttttgtagagatggggttttgccatgttggccatgctggtcttgaactcctgacctcaggtgatccacctgccttggcctcccaaaatgctgggattacaggcgtgagcctcagtgcctggcctgaatactctattgaaagtaaaaaacagaatggctccatgggcacgtgaagtacggtttctattgaacgcatattgctttagcaccatcctagagtcaaaaaatcctaagttgaaccaacctaagttggggaccatctgtgtaatatgatgaaaatgtctgtctttgttgtttaaaactagtttagaagggccgggtgtggtggctcaccgcctgtaatcccagcactttgggaggccaaggcgggcggatcatgaggtcaggagattgaaaccatcctggctaacacggtgaaaccccttctctactaaaaatacacaaaattagctgggcgtggtagaatgctcctgtaatcccagctacttgggaggctgaggcaggagaatcgcttgaacctgggaggtggaggttgcagtgagccaagattgcgccactgcactcagcctgtctcaaaaaaaaaaaaaaaaaaaaaggaaaacaactagttgagaaggagaactgaaacattgttttgcaaaagtgttgctgtgaacaatgggcgctcatgtcctctatggtgcagattccccttgattcatagagtgctttatctttgtaactagctatattttttctatagtaataccaccattaaaggaattaaagtgacattaagaatgaagaatgttttaaatcttttaaagtcttgtgcattctagattcagtaaaattccagtagtaacaagattttgaagcaactgcagaaactctgcacagccccacgtgtaatgtggctttagaatatgtgtttcttcgcctgtagtctcagctactccagaggctaagacaggagaattgcttgaacctgggaggtggaggctgtagtgagctgagattgcgccactgcactccagcgtgggtgagacagagtgagactccgtctcaaaaaaaaaaaaaaaaaaaaagaatatatgtttctttcttgtgattgtgtgttgctgtggttcagtgattgtgtattgattgtggctcagtgcctggcaaaacatttgtactacagatctctcagtaaggtgatctatttttccatttatatgcatatttatttatgttaccatcagtagttctccatagcttcttttgtagttctccatagcttaattttgacgttcacataatcctgatttcttagagtaatatcatttatgacagattttatagtatagtggttaaaaatatgggctttataagcagactgatttttgtctccactgcatgtgatttttgtgatcatgggctagtttgaatctttggtaactttgttttcttattggtgaaatgggtataattatagtatctgtctcagggttgtcatgaagattaatgaattcatgtaattaaagcatttagaataagatttggcacatcaaaatagtagttattattataatggctcgagtttttggttggaactcaaaaaacaaataagatagtctttgttttctgttttatcagaaagcacttccctatgagaggataatcagggattaggaaagaaaattttaaagaaattcatattttctattggcagatgtgattgctttaaaagaaaatcatgttttgttttttttttcatggaataaggcattgaatccagtggctaaaaggaattgatattgtgtacccagtcttggataatgccagtcaattctgtaaagatgaaatattaaatttgtgctattctgtaacattggtagtcccaacatttttcctggactgtcaatgaatttttgattatctgtgaacattgtctcttggataattcatgagcacattagacccagcacttccaggttaattttgccattttactccaagcctacaccttgacctttattctctgtacaatgaatggtagtattatcagtcaatccattcataatcctagggatcatcctaaacgtttctgttctctcattttccatcttttatatctgggcaatcaacaaattctgagacttttctataaaccttctctgtaagacagatgtgatctttttgctccctttcaaaatatgttttactgcccccctcccaatgttttctgtataaagttcagacttcttagcaggacaacatgagcctcatattgtgtggtattttcatgtgcatatcatcctcccatcatgtggaacgatttgcaattccatgaaaatgccattctcttaccattttcattagtgtaaacaatttttagtgcatagaaagctccctaattttcttcttctcttactttattatctccattttattcaactcaatcattacctcattgaaaatttatttacaaattcgcttcccaagacaggttaggtgtccattgtattttgcttctcctttacattctgtaacttcatatgaatacagttggctctttgtatcaatgcattccacatttgtgggttcaaccaatggtggatcaaaaatgttcaggaaaaaacaaccaataaaaataataactagtaaaaataatacaaataaaaaccaatacagtataataactgtttacatgacatttacattgtactaggtattataaaacccagagattatttcaagtatatgggaggatgtgtgtaggttatatgcaaatgcaacaccattttttataagggatttgagtatcagcagattttgatatccactggggctgctagacccaatcccccagatactgagggattactgtgtctttattaaagcacttatcaaacaatatgatcattagttttttatcagtgtctcccactaaattatgaacagttcaaatacagggcctatttatctctaagtgcttaatgtttacttttaggcatatggttggtgttgagtaaaagtgttttgaattagtaaaagattttgaactaaaaatctttggtaaaagttacatgataaacctgtctttaatgggagatgatgggaattaattgctaatagctattatcaagaggcaaaaataaagaaatggactgacatccaggcttttacccgtttgacattagccactctgctagtttcttcctcttactggtttatcactttggtgttaactatttggtcttgtctgctttcttgttagtactaatcaactctgtcaaaaattgcctgtttctcacttaacctagttatatcaccactgtatttttaatactttttgttaatgctgtttatttttatcagatgactattaagacaaaagttttcgcttatgtttggcgcattggttgtaataaatgtgaagtggattctttaagtcaatttaagggcatctggcaactaggaagactaatccttggagtgaattaagggcatgaagacaaggacctgtcatttataggataagaggtcagtgaactatgtgggcaggataaatatatcaattagggagtttccctgagagtgggcaagaggctaagaatctgagtcaataggtcaggaatatgtagacagtaggtaaaagacatatctagagtgccagatggactagtgaggtagaggttatatgttttcattatattttaggggtatttgactattaagtgagaaaataatgctgtttgggggaagctggccttggaaaatagtgcattcccattagaagttgatagaatatatacgtagtggaacatcttggtcctggtagtgggatactaattatgtttattgtattaaccctatttgattcaggattgtttttgcctacaaataacttagttcaaactaggtcttaacaaaatgcaagagactaatgttcatatttatttagtgaataaattggagtagttttctgtgctattggtggaacaaattaaactttcactggttgagggcttacacctacacagtatagtgtgggaggatcatcagccagtttgtcttattgttttattggcagcagaaaactcttaaactgtgttttcccatggaagaggcatctcacttgaaatctcagaacttatactaaaaaatttatgaagtgggatgatagtgaattacagaagagtcatcaaagaaagtatgtgattaactgacagtttattgacttcatcctcagggccaatttaaagaaaagtgaggcagagttagatttcaagctatgctttgaatgctgtgtgaggtctttttgagctttttggttaagctgtaattaattaactcgattaaacaagtattactacatgaataaaagtacacacacggatttttcaaagaggtaataatgggttcactgctgataaaactgtggatctgagtttggttaacattaaagagcactccaaaattcacctgttgttttaatctcttgatagagaatggtaataattagggttctatatatgtattctatatcttttaatatatgtctatctctgtatgtttgtatatatttatttgacttcagagaaaatagcattaaggtttccttttccttttcaattatattttaaaatgttaacttttaagttagcttgaccctttgaaaaattgttaaaaattactgtcctcaggctttacaacttgtacagttatataatttcactcacagatatgaaagcaaagaaatattttaaagtcttctattttcaaatgcttcctaagaaagatgcttccagtttatgaacaataaaatgaaacttcataggtagaacattttttttaattcctgaatattgagatactgagtcccttttggtttgttccctaaatataatttcatttagttatttttgttaattctgaaagcagcaacagtatatgctatttcactggttattttcatatctgattttgtttatttgggtcttatctcttttttgattattacaagcaaccgaccatcgattttgtttatctgttaaaaaccttttccttttgttgatccctttttcattgaagtttctatttcatttagttctgctctgacttttattatttcatgtcatctcctaattttgggtttggtttgttcttgcttttctaattccttgaggtacaacattagatatttgaaatctttctacttttttgatgtagatatttattgctgcaaatttcctaactagcactgcttttgctgtattccctaggttttggtatgttgtgttttcattttcatttgtttcaagaaactttctaatttcctccttaatttcttcattgacccaatggtcattcaggagcattttgtttaatttctgtatacttgcacagtttccaaagtttctgttattgatttctagttttatcccattgtggcctgagaagatacttgatataattttgattttttaaaatttcgtttagactttttttttgttttattttttatttttaattttttttttaattacacttcaagttttagggaacatgtgcacaacgtgcaggttagttacatatgtatacatgcaccacgtcggtgtgctgcacccattaactcgtcatttacattaggtatatctcctaatgctatctctcccctctcccccaaccccatgacaggccctagtatgtgatgttccccttcctgtgtccaagtgttctcattgttcaattcccacctatgagtgagaacatgcggtgtttggttttttgtccttgcgatagtttgctgcgaatgatggtttccagcttcatccatgtccctacaaaggacatgaactcatccttttttatggctgcataggattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtgtatccccagtaatgggatggctgggtcaaatggtaatttctagttctagatccctgaggaatcgccacactgtcttccacaatggttgaactagtttacagtgccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtctgtgggctgcatacgtgtcttcttttgagaagtgtctgttcatatccttcacccacattttgatggagttgtttgtttttttcttgtaaatttgtttgaattcattgtagattctggatattagccctttgtcagatgagtagattgcaaaaattttctcccattctgtaggttgcctgtttactctgatggtagtttcttttgctgtgcagaagctctttagtttagttagatcccatttgtcaattttggcttttgttgccattgcttttggagttttagatatgaagtcattgcccatgcctgtgtcctgaatggtattgcttaggttttcttctagggtttttatggttttaggtctaacatgtaagtctttaatccatcgtgaattaatttttgtataaggtgtaaggaagggatccagtttcagctttctacatatggctagccagttttcccaccaccatttattaaatagggaatcctttccccattgcttgttttcatcaggtttgtcaaagatcatatggttgtagatgtgtggtattatttctgagggctctgttctgttccattggtctatatctctgttttggtaccagtaccatgttgttttggttactatagccttctagtatagtttgtagtcacatagtgtgatgcctccagctttgttctttttgccaaggaccgtcttggcaatgcgggcccttttttggtaccatatgaactttaaagtagttttttccaattctatggagaaagtcatccgtagcttgatgggggtggcattgaatctataaattaccgtggccagtatggccattttcatgatattgattcttcctatccatgaacatggaaagttcttccatttgtttgtgtcatcttttattttgttgagcagtggtttgtagttctccttgaagagatccttcacatccgttgtaagatggattcctaggtattttattctctttgaagaaattgtgagtgggagttcactcatgatttggctctctgtttgtctgttattggtgtataagaatgcttgtgatttttgtacattcattttgtatcctgagactttgctgaagttgcttatcagcttaaggagattttgggctgagacgatggggttttctaaatatacaatcatgtcatctgaaaacagggacagtttgacttcctcttttcctaattgaataccctttatttctttctcctgcctgattgccctggccagaacttccaacactatgttgaataggagtggtgagagagggcatccctgtcttgtgccggttttcaaagggaatgcttccagtttttgcccattcagtatgatattggctgtgcatttgtcataaatagctgttattattttgagatacgtcccatcaataccgaatttactgagaattttttttaagcatgaatgcctattgaattttgttaaaggccttttctgcatctattgagataatcatgtggtttttgtctttggttctgtttatatactggattatgtttattgatttgcgtatgttgaaccagccttgcatcccagggatgaagcccacttgatcatggtgtataagctttttgatgtgttgctggattcggtttgccagtattttattgaggatttttgcatcagtgttcatcagggatattggtctaaaattctctttttttgttgtgtctattccagtctttggtatcaggatgatgctggcctcataaaatgagttagggaggattccctctttttctattgattggaatagtttcagaaggaatggtaccagctcctccttgtacctctggtagaatttggctgtgaatccatttggttggtaggctattaattattgcctcaatttcagaacctgttattggtctattcagggcttcaacttcttcctgttttagtctttggagggtgtatgtgttgaggaatttatccatttcttctagattttctaatttatttgcgtagaggtgtttataatattctctgatggtagtttgtatttctgtgggatcggtggtgatatcccctttatcattttttattgtgtctatttgattcttctctcttttcttctttattagtcttgctttggtctatcaattttgttgatcttttcaaaaaaccaggtcctggattcgttgattttttgaagggtgttttgtgtctctatttccttcagttctgctctgattttagttatttcttgccttctggtagctcttgaatgtgtttgctcttgcttctctagttcttttaattgtgatgttacagtgttgattttagatctttcctgctttctcttgtgggcatttagtgctataaatttccctctacacactgcttcagatgtgtcccagagattctggtatgttgtgtcttttttctcattggtttcaaagaacatctttatttctgccttcatttcgttatatacccagtagtcattcaggagcaggttgttcagtttccatgtagttgagtggttctgagtgagtttctttatcccgagttctagtttgattgcactttggtctgagagacagtttgttataatttctgttcttttacatttgctgaggagtgctttacttccaactatgtggtcaattttggaataagtgtgctgtggtgctgagaagaatgtatattctgttgatttggggtagagagttctgtagatgtctattaagtccacttggtgcagagctgagttctggtcctggatatccttgttaactttctgtctcattgatctgtctaatgttgatagtggggtgttatagtctcccattattatagtgtgggagtctaagtctctttgtaggtctctaaggacttgctttatgaatctgtgtgctcctgtattgggtgcatatatgattagggtagtttgctcttcttgttgaattgatccctttaccattatgtaatggccttctttgtctcgattttgatctttgttggtttaaagtctgttttatcacaggctaggatttcaacccctgcctttttttattgtctgtttgcttggtagatcttcctccatccctttattttgagcctatgtgggtctctgcatgtgagatgggtctcctgaatacagcacactgatgggacttgactgtccaatttgccagtgtgtgtcttttaattggaacatttagcccatttacatttaaggttaatattgttatgtgtgaatttgatcctgtcattatgatgttagctggttattttgctcgttagttgatgcagtttcttcctagcctcgatggtctttacaatttggcatgtttttccagtggctgctaccagttgttcctttccatgtttattgcttccttcaggagctcttttagggcaggcctggtggtgacaaaatctctcagcatttgcttgtctgtaaagtgttttatttctccttcacttatcaagcttagtttggctgaatatgaaattctgggttgaaaattattttctttaagaatgttgaatattggcccccactctcttctggcttgtagaatttctgccaagagatcagctgttggtccgatgggcttccctttgtgggtaaccggacctttctctctggctgcccttaacattttttccttcatttcaactttggtgaatctgacaattatgtgtcttggagttgctcctcttgaggagtatctttgtggcgttctctgtatttcctgaatttgaatgttggcctgccttgctaggttggggaagttctccggataatatcttgcagattgttttctgacttggttccattctccccgtcactttcaagtacaccaatcagacatagatttggtcttttcacatagtcccatatttcttggaggctttgttcatttctttttactcttttttctgtaaacttctcttctcgcttcatttcattcatttgatcttcaatccctgatgccctttcttccagttgatcgaatcggctaaggaaggttgtgcatttgtcacgtagttctcgtgccatgtttgtcagctccatcaggtcatttaaggacttctctgcattggttattctagttagccattcatctaatcttttttcaaggttttcagcttctttgagatgggttcgaacttccttctttagctcggagaagtttgatcgtctgaagccttcttctctcaactcgtcaaagtcgttctccatccagctttgttccattgctggtgaggagctgcgttcctttggagggggagaagcgctctgatttttagaattttcagcttttctggtctgttttttctgcatctttgtggttttatctacctttggtctttgatgatggtgatgtacatatggggttttggtgtggatgtcctttctgtttgttagttttcctgctaacagtcaggaccttcagctgcaggtctattggagttttctggaggtccactccagaccctgtttgcctgggtatcagcagcggaggctgcagaacagcaaatgttgctgaaccacaaatgttgctgcctgatcgttcctctggaagcttcgtctcagaggggtagccggccctgtgaggtgtcagtctgcccttactggagggtgcctcccagttagggtactcaggggtcatggacccacttgagggggcagtctgtccattctcagatttcaaactctgtgctgggagaaccactactcacttcaaacctgtcagacagggatatttaagtctgcagaggtttctgctgccttctgtttgcctatgccctgtccccagaggtggagtctacagagtcacgcaggcttccttgaactttggtgggctccacccagttcaagcttcctggccgctttgtttacctactcatgcctcagcaatggtgggtgcccctcccccacccttgctgccatcttgcagatggatttcagactgctgtgctagcaatgagtgaggcttcgtgggcttgggaccctccaagccaggcacgggatataatctccttgtgtgccatttgctaagaccgttggaaaagtgtagtagtagggtgggagtgtcctgattttccaggtgccgtctgtcacatgttcctttgggtaggaaagggaattccctgaccctttgcgcttccctggtgaggcgatgccttgccctgctttggctcatgctcgttgggctgcacccactgtcctgcccccactgtccaacaagccccagtgagatgaacccggtacctcagttggaaatgcagaaatcacccgtcttctgcgtcgctcatgctgggagctgtagactggagctgttcctattcggccatcttggaaccacccccgagacttgttttgtgtcataacatgtgatctaccttggagaatgttccatgtgctgatgagaagaatgtatattctgtagctattgaatgaaatgttctgtaaatgtttgtaaggtccatttagtctaaagtacagcttaaatctggttatttcattgttaattttctgtctagatgatttgtctcatgctgagagtagggtattgaagtccccaactattattatattggagtgattgtcctcctacctcagcctctcaagtagctgggactacaggtgtgcatcactgtgcctggctaattttaaaattttttctagaggtggagtcttgctgttttgtccaggctggtgtgaaactcctggcctcatgcaatcctcctgccttggcctccgtaagtactgggattatgagcgagaaccactacagccagcttatctcccattttagagctaatgatatttgctttatatatctgggtgcttggtgttgggtgcatatatgtttagaattgttaaataatgtatcctcttgctgaactgatccccttattattatattatgaccttctttgtgtctttttactggttttgacttgaagtcttttttatctaatataagtatagctgttcctgctcttttcttgtttcaatttgcatggaatatctttttccatctttatgtgtctttacaggtgagatgagtttcttgtcggcagcatatagttagatcatgtttttttataatccatttagccagtccatattttttaagtgactgtttacattcaaggtttttaaaaatttatttttttgttttttgatggaatctctggcatcctgaatctggatatctaaatctcttgctaaacttcagaagttttcagctactatttcattaaatagctttattccttttgctttctctttccctctgggacactgaaaatgcaaatatctggttgcttgatgatggcctctgtgtcatgcaggctttgttaattgttttaaattctctctctctttttttttttttaactaactgggttatttcaaaagacctatcttcatgtgctggatttttttcttgtgcttcatttagtctattattgactctttcaagtatatttttaattttattcagcagattttttatttccagaatttccatttggttcttttgtttatcctttggtaaatgtctcattcaaatcttggtgttttttttttaaatttctttgcatcatttatgtgtgttctcttatatctcaatgagcttctttataatcaatattctgaattatttccccaggattttgtaaatttctttttttttttttgagacggagtcttgctctgttgcccaggctggagtgcagtggtgtgatctctgttagctgcaagctccgcctcccgggttcatgccattctcctgcctcagcctcccgagtagctaggactacgggcgcctgccaccgcgcccggttaatttttttgtattggaatttgttgcttgagaattattgtgttctttgggaggtgtcatatttctttgccttttgtatgtgtgtttcttttgttcttatgttgatatctgcccattggtagaacttttgctccttccagttttttgaatttgtttgcataggggaaggcttttacctgaagatgtatctgtcatcttggttgggttagggaactttggtgttgattctgggtgcattatatggtggttttctggtgggatgcataggttgggctagctgtggccctggtgctctggaaggcagggttgctttcagtgtcagtggtgtaggcttgcaactggagaatgcctgctttggccccaggtgttggatgtgagtggggtagcctgtccttagggtgcttataaatgcacagttgctttgctacttggagtggcagggccactggcaatggcttttgctttgggcctaatggtggcaaccagccttagtggcagcggagggcagggaatgtcagtgggaatatagggatatggagatgtaggggctttttggccccaggttatgatgcaatctggtaggacctggattctcaaagtggtgctatgctgtagttgcttaggcctcagggcgtttgggacatggcataagcgccctctctgcagcaatgccattacatggtttcccagcacctccctatgttagtttcaggggcctgtgagggtcaaggttctctctcttcactagaattacagggatctgtgggggaaatgtggactgctggaagtttctcactgaccctttctcctcattgggatgcctctccagggtcgcagccggtcccagtcaagcatgctccctcacttctttttccttcctttcttgtgttttttctcactcttgttgaattccattgttctttcttagaggatctatttgaagagtgattatttactcactaggttcttctgtgtgaaggggatgagtaccagatgcctctagtcagccattgtgaagcccctgtcttgtggctttatttcttatttcctgttataccagtagctttgatgtgccatctttatgcaacaattttctaatgcacacaatttttggaatctttttttctgttttagtgatatatgaaataatgtcgaatcttgatattatgaaatacagaaacaaatgttcttactaaaagggaatgcatgtcagctataagaaatggtgtatggccttggggctgcttcacaggtggcatagaatggcctttgtaggaacatcttttgtggctcaaagttataatgagttcatctactgtattccttgctctgtttataagcaaaacctctttgaggttatcccagatctggcaagccaacatagtttcatatcttgcatgattatttagtgagtgggtatggatctgaactttagataaagtttttttttaaattatttgtacttatttatggggtacagtgtgatgtttcaatacatgtatacattgtgtaatgattaaatcagggtaattagcatatccatcacctcaaacacttgtcatttctttgtgatgacaacattgaaaatcttctcttctagctgttttgaagtatgcatacaaatcacaaggaatttataataatactatgcaattacagaatatagtctaataatgttactatttccaccattttaggttttcatatacatttgtgtgtctgtgcatgtgtgtgtagacataaaattcattttattttttaataaattatatgttaactgaaatcctctgggtaaccattccttcttctcagtcctcccttaatttgaagtgataacttctaaaaattcactatgctgtatggatgtgtatgtggatttaccttggtgtaataaaaatatcttgaataataataataaaaaaggcctagagaacctgaaccattcagttattatttgaacaatgggacttctctttgaattgagaggtactgaaggacttgttcatcattaatgaggatatgtaacaccatgtgaattactcaattcactgttttaaaaagttttgtcatgaatgtaggtgcatgcactaaggtactataaaatcacaagctaataggggatatctgttttatatatgtatatatatgtgtctgtgtgtgtttattccaactgtgtttttttggggggttaggaacattacggagcctttagaaagctttactttactgttaacatttaaaactttgacagtagttttcaaactcagatattaagtttatgccattgtgttcttgccctaatttactgcctttgcaaattaagcattctttttgaattttcctattggatggggtaatatttgagtgtatataaacaaccaaaagactattttgagtagcaagcattcataaaatggttgatgtgcttattcagttcatgagcatactgatattgaataacaatgctgtgcaattattctataaacaaatattcattgaatacttattgggtaatatggtatgtaaaagagagagattgatgaataaattccagtgataaaaatatagcctctttatggtacttccagtttatctattcctgtcctgtatggtagatctcattttaagacaaagaaaagaataaacaaatttaaattatggagtaaggaacttcaatataagaaaatatcctgtcattgagagtaacttacatggaattattattttttttatttttgggatggagtctcgctctgttacccaggctagagtgcagtggcatgatctcagttcactgcaacctccacctcctgggttcaagcgattctcctgcctcagcctcctgaatagctgggactacaggcacgcaccaccaagcctagcagctaatttttgtatttttattagagacggggtttcaccatgatggccaggctggtcttaaacttctgacctcgtgatccacctgcctcagcctcccaaagtgctgggattacaggtgtgagccaccacacccgccctacatgaatttctttatgagagaagggtcttattactgagattgttcaggtgtgttattttaaggccaaagaaagtctagttattgttaaaattaggggcataatgatgtaatgtagtagctctcaaccctatcaaatctaatgcccctttttgtaacatgtattttcttatgtccctttactatcttgaaataaaattcataattgtactttcctaagcttatgatttatgaataaatctatataatataatcttattaagggagaaataaaaggaaagtaatttataatagaagcacacatttttatatttagagcataactagatttgaagacatgatgaggtgttcaggtaagatactcagcctgccacatgtattgtaccgggacagttacaagtcttgcctgtgtatatgtgttgcatattggcaatgaatatcctcaaatgaaatagccgtgagtgatgtgattttctaaaatggtaaacatgtctttgtcaaatgcgaaatgatataaaattttctcctatattgctgagagatagatttctggagctttctgggtctattaaaagtgggtgaaaactgctttgtatttagatgtaaaattgagttagagtctaaattcaagtaattatctacaggtttttaacttacatggaaatctgcgagaatatttcaaaattgttcaggatgtacgactgttctttgttgtaaaaggattgttttggacattgaacaacttcattattcttggttgatggttaatgtcagtactgtctcctaatcattgtgacaaccagaaacactaatttttaaaaaatgcccccagagtgtggtgcaactttcatatagaattgactgtctgtagaacaaagagaaagtctacaggcaagagtcacagccttggatttgattcttgtttcttctacttaccgccttcttactgaggttttgatattggacaagataatcgaccttttacagtcttagtttcctgtctggaaaactgggatgataatatctcacagagttgttttatggattaaataatataacgtattttaggtacctgacatgtgcttcatgtgggatgggactatatctcttttatgcaccactttttcatcactagtagacacttaataaatacgtgcttactcttgttatttaactcctatatgtcacactctgttccaatattaaaagcatgagagggagtgattgtttataataggcaccatgtctatcatctgtgtctttcctttcaatgttttagaacttgtgaatcttagatgagaatgcttgttctttggaattgtggccttcagtttctaagaccttattaaatagaaatatgatggtttgctttacatttgaaagggatttatgggataaaggtccgccttaataagcacactaatttcccagcatcctgatattttttcttatttatttatattgttttgctaatgtcaggatggatagtgggggctatgtaaaagaccaaggacctcccttctcctgggaatcctaatctttgttacactaatgtttaaaatacaacatcagtaatttcttcctcttcttcaattttctttttactcttcctgtgattttggccaattaatgttgatatattttgttttcttagtaaatatttgctatctttgttgtgttacttgtttaactttaatcttagatgattcaaaccatttactaatgtaagatagaatagttacttttggcaattttaatgcaacttattactttgaaaatgttagaagggacccctagttttcctttgtaaattgtcgtttatttggcagagaaagcatttaatctgtaaatgctgctctgtgttttatagaatggtgaaccttacaagtattttatcccaaatagatgtttattaaaattttaacttaaatatttgatgattattatgaataagagtttttaaagcagtcactttgctttgatattcacagtgtgaacaagctaaaattttctacctactttctcttctttttattcttccaggtcacctttgtgtcaggcattgctactttggcaaacctgcttgcctttgacctttggttactcagttttagtttggttttgagccagtgtgtgctgaaatctttaaaactaaacaaatatttagcattcatttgatttaccaacaattgtctttttaaatattcagtcactccacaagaaaagtaactattgtcagttacagactgtagtaccaaagtcagattctggaacattctataaattactaaaaaactatcaggttataatttagattggctcagatgattttaggttgttttagaagctgacggtatttttactcacaattttctttcttttttctttttcttttttttttttttttttgagacagagtcttgctctgtcgcccaggctggagtgcagtggcgtgatttcagctcctgcagcctccgcctcccaggctcaagttattctcctgcctcagtctcctgagcagccaggattactggtggcaccaccacgcccagctaatttttgtatttttgtagagacggggtttcactgtgttggccaggctggtctcgacctcctgaccttaagtgattcacctgcctcagcctcccaaagtgttgggattacaggcatgagccgtcgtgcctggcctattccaaattttcgaatgtgcgtaaataattaatatagatgactatattagataagggacatgatatttttcctaataaaagtttaaaccatatttttatccattctctggtaattatttcttaaaaatgtaagtacatcagagaaatgatttattcatttccaaggctgagaaggtgaattttaaatttgtatttgaataacatttgtaattttactttacttgcacataacattatttttgcttagtaagcttatgaatcatttaattcctactatatgagaaatgtgttatgggatattgagaacattatgatttaaacgtaatacatatttagttgtcttcaatctcatttctatctctttggaaattaaaaggttccaaaactaagactgtgggaatgaaagtgagacttttgttttcttttagttgtatcaaaatgtaaattcctgggaaggctatttttgccttttgtgtcacaattattatgggaagccaaacaagctgctattaggtgttagagaatacaataaaattagacccttatttgctcactggccaaagaccacgtgttcctttagttgtatccttcagacgagcaaccttgttgtttgtgcccttgcttttgccttttcctttgtgtaattttgttcttttcctagagccatttgtaattgactgctgtttactaatagtttagagcaaaatagccacctttttcatggaacacttcagagccaactgcatcattaaaatgtacaaatgctctatgaaaatgtattcagttagtaagattaggctgaattgctagatttaggctttactagatcactaatattttcacttaattaaggctagtactttttttcctgagtagagattccgtttgttttcaagaactcaagaatatgctgctgctctttatgttgctctggaggcatgaatgtaattttgcacataaaaatattctacaaatctttccttaagagaataagggaggaaaataaaagtacatttttaatttgagggttggtcattagacttattttgcctataagattgacagcgtgactgctctttaaatgttgaattgggagtttaacatgaatgcaatccacatgtctgtgtcagagttttttgtatttttttcctggagatgggaagtataaacatgcaaagacttagctattgcaagaaccttattttggtttcttaccctgttctgttttgtatctgcatttgtaaaggaatttaaggaagttggaatggatgcaaagaaaaggaataatcatcattaggatagaaacaaagacacaaggaaaacaaagtatagttcttaaacacgattgtcttacttccttgataattctttctgatgtgtgttatcttctgcactctgtactaagtcacaaaagatgtacaaataatttttaccagaaaagtatagaacagaatcagaatgtgaattacttgctcaggacatagttatccaacattgtttaataattatcacaagagagccaaatactaggaacgaccgactgagatcttcagcctagagggtggggtagacaggcttggccagttcgtactctttcgttccttttgagcaagggaggaagtacaggtgaatgtgtttaatagatacgtgttcactgatgtatacacaacaaactttcactttgtttttcctttcatacctatcatgacactcttagctgcatgacggtaattacagagacagagatttcttagtaatcttctcagggagcatagagagttttaaacagtgactcttaggaaagttggtcattttctgtctcaacaaaggatagagggaaggaaactaacaattattgaacaatatttccagatactatggttgatgcttattttcttacatccttaaaaactcagaatagcccagtgaagaaagaactccttcatttttgcattgagaaaacaggcttaggcaatatattgcaatatggcttattaaccatctcaaagacacataactaataagtggcacaacaaggaattgaaccaatatgtttatatccccaaagctctctattatatcatgccatctcaaatcaagtgtctaaataattggaaatggaagtaatagagagtttagttaagtacaacttagataggctattatctaagcacaattaaaacttagataggctaccaagtacacttgaaaacatagtgctgtattcctcttccccaataaggttgttgttctaaataattagcttgcattttgattaatcttgattgtgctctgatacaaaatattgcaattatttgacttgcaacctgctttatagagttagtgatttattgaatatcttggaagcaagtccttgacaggcagtattttaaggtgaaattgctatgtgaggattttgttaacctgacgttttgtggtttcgcctcataaaactggcaaaggactcccagcgtggaatgttaatggggtgaagtaatgaatgcaggctgagttacaagcatccagatatgagcaatcctatagttcatactccatgattcttgcgggaggtctttgtagacagaagctttactaaaagataaaagcagtaggagatcgttaaaactcagcagttgatcaaactctttctgaaacctaggcttagaagccaagcagagatatgaacatgggaaagtaattaatctattatagtctttcatgataattttcactttctcaaactgttgaagtaaataattgttgggtacctatttactctaaccaaatattaacctttttattcttttcagcttttaagtactgcccattccacttctatattttgatccctcaatcagatagctaatttaattccagcattagttatgcagattttattccactggaccaaagcaatatactgtgttcctcttcccatttaattttattttaaaactttgcttgcagagctgaaagatttcttagagttttcatggggctggggttctggctgcttgcttctagattgtatcaaagcagctctgccttttttctgatttatttgttggactactccatgagattttgtctgaaaaaaagaaaaaatgtcctgttcctaagaaagtttgaaagccacatatatagctgtttaatttaaagggtatcaattgtaagatatgttttcaacatttttgttgatcacgtatttcaagtgacagagcacaagggtatagattaccttgaatcttgtattctaaagaaaagaaccaattatttatatattgaggggaattttaggacttgttactataatgtagtcagttttgtagattacatctagttacaaagattatatatggttttaaaaattgttgtattttgatattttatttttaattaaaggctcttccttctccttccattgtataatcatattaaggtatcttttagataaaatctgaaaacacttttcttaatcattctcattttcattgagattctgaacaggtaggctagcattattgttctcaaatggctaatgacatattttaatctatgctttactgcttatacaattagttaaaaggtcttaaaattctttgagattctcttctttaagaaaaaaaatacaaagttccaatatgttgaagaggttgggctcaaactcctgggttcaagcagttctctcacctgggccccccaaagtgttggaattacaggcatgagccactgtgctcggccaagattctcttaaattcatcttttgctttttatttccgcttaccctgctttagactaacttctcaccgtcaatcacagaattggttggatagtttgctttcttgctaattttgccttctttcacttgttctctataaattgtccagactatcagataaaatccaaatgtttcatcctttgcaactgctcatatactgtctaacttagtgaaacaaactgttttcattgttatttgttcttcagaatactacctcctaagtaaatggtacctccctatcaaaggcaattttgtgaaatgtattattcaaagcaaccttagcagtataattcttatctgtgtatatctgtggctcaagccaaaatctcaatcagcttaaatctggcatctcaggggagagttattatttagttcccttaacattattttccatgattggcaaggacctagtcaagatgtttttgttagttcctcttagaaaaaagatcacttttgggatatcagctttcaagtatcaggtaatttcctgtttaggtctttatataaatgcctatcaacccttataatactttttattttatccctttgtatctacattccaaataattaaatcatgcattccttttacggcccttagtatctcaaccaaaataaatttttattctttagatttttgccctgattaaattatttatttgttttccataggatatgttttttgggggtcatttctcaatactcccaaagctgtaccttaatgattggtttacttacatacccttgtaaccagtttattgaaaacaaaaattatttcttactctacagttttccttcttggcaatttcttattgcatttccttctattctgtgcacagaaaaacaataatgtattatagtggaagtattggggagatagtgactcaaataattttctgtgctttgtggtttagatgaggaaccctgcttgaaaaaacaggcatgtgcgacaggtactcagtgtatatattgagtgaataaatttgtgttatttacattttatgtttgatatgtgtatcttatttcccaactatattctaagcttagggagagcttaaacaatgtcctcttctatatgtgaatttgtctaattggtaagtaagtagtttatgaaaaaattaaataatttgaaataaggcagaatttctatctatcatctctaggtagcttttttttttttttttttttttttttttttgagacagaatcttgctctgttgcctagtggcacaatctcagctcactgcaacctctgcctcccaggctctcctgccctgctaatttttgtattttttgtagagatgaggttttgccacgttgctcaagctggtctcaaactggagagctcaagcgatctgcccacctcagcctccgaaagtgctgggattatagacatgaaccaccatgcccagccatccctgcatattaataaatttcatgtatttgttagtctcctacaaatatatcatttatcacaatttattttatcaattttgagatacttttttcatactttaacttttctgaaaataaatggcctcttactactggcctcagttgaagttcagctctgatagagggagtttgtgtttgcctctggcattcaatctcagacacatgagaccactttgaattaagttgttagatgatttttggatttcactgatagtgtgaatttagactgccataattgttaatactgggttttggtttcaattttatgagatttcttcccctaccctccacctagtacaaagattcgtttatgagtttcttcctatttctgtctacttcgaagagtttttttctttaatcttaaacaaaggtgtaccccttgggtcttccaattctatgtacatgtaaaataattgtgtgtcatgattgatggtgtcttagataagaagaaatacagaattgcagtcaacctaattgggtagaatggcaactgcaggaaattgagtcatcccaattcaatttaaattttgaagtttaccaatgactaaccaaatattattaaagaacagtgattttatttgggatttcactttcaaaatggaatttacattaatgtagtatttagatttaatgtattaataattaatataggtagccagtcaaataaatggcagctagccagtcaaataaatacaaaaatttgcatcagagcacagtcaagattaatcagacacaaggtagaagcatggggagacagatagagcagtcaacacacataagatattatacaggtgggagggaaagagcacatggggttaattaaaacacaagttacaggcaagagactagagatagggcagtcaacacacttcggatactgtataagtggatgggaaagaccacactatctgaatctggtggcatggaatgtttatgtatcccctgcccactttacagatgactaacttaccctctatgtttataacacattttatgatctctactgtttcataagctactttggttactcacaatttgtatgatttctatctgtatctcataagatgctagtttacttactatctatggttaacatttcttatgagtcttattcatcctgtttttcttgatttataatgtaacagaatattctcaaacaatacacaaaatataccttacaaaaattctctatcagtcaaggtttaattagagaagcagaaccactaggagatatacttttaaagtagaagtccccgatctgttggccataggccaaaatggttccatggtctattaggaaccaggctgcatagcaggttagtggtgggttagtgatcattactgcgtgtacaccatctcatgtcagatcagctgcaacattagattctcctaggagtgcaaaccccattgtgaactgtgcatgcaagggatctaggctgcacgctcctcatgagaatctaatgtctgatgatctgaggtggaacagtttcatcctgaaacaatcgccatccctgaaccaagtccgtggtaaaattgtcttccacaaaacctgtccctggtaccaaatggttcaggagtgctgatagaaaggatttattataaagatttctccatactcaattgtgggagttttaaaaaaattctgtgggaactattacttttgtgtttggtgctatcacctgaggtcagcaaggcaggaagttgagctgggaaaacagatatgaagtaggggaagcaaggacaaatggcaacctgaaaggtttagtgggacctggatactctctgtttccaactttggtgatataggtgtcttgtaggagaagatagctaaattttaaacctgagatgattggataagataacttttaacaagtttcaagtatttgcaaggagatagaaaaatcaggaattgatcaagttaagatttttgttactatgttggtctttttataaaatggctattttatgcaaataaagaagcagttaatttttttcagtcagtttgagtgttttaaatcaaaatattctttgatatcttctgaggagatctcaatttgtccagctacatccctgcagtagaagaagagtgtgaattcatacatctgaaaattccagcccaaagcaagcagctacgaaaggaaaatctactttacgtctcttagattaaaaatctttgtaagtttgacattctactccacaatgcattctgtttgttttacctctcctccccctagttattagattaagttgctcatctactaagacctactgtgcttattttttcagttgagtgcttcttagcttaccactatacatgcctatatatgtaagtaccctcttttgaaaagtctagctcatgatgatttctaagattccttccagttgggctctttctggattatagacttctaaagtattcaaaattgtgaactgttatctttccagtttttatgtgaaacatatagagtgaaaatttaattctcttggccttgttttcataggtataaaccctgtattttagtttggggcatattctgaaaaaatgattcatttcaataaaagcagctatagtatattacaatcaatgcttatattcaagcatgtgtttagtaaaatgaaatattattaattttgaaaagatacatttttaaggtattatggaagaacattgtggtctatatattttgttttgacaaaatcaccttagggaatgcagatcataattttatgtctacatttttttgccttgacatccaatgcatgtttttagtaattcaaggaaatccatctgctttaagaggaaaaaccctgttaattccagattataaataaaattgatctttttgagtgtaatttccagtttcgtttttgaagcaacttatttctttctgagccatcagctgtagtggattacattaaacataaccactaagcattctcagtgaactttatctttctgtttttcctacaaatatatttcctctaggattttattaaataatgtcattcttatcatcttgacagattctagtaacagactgcaacatagtgaatctaacagcaaataaaaataaaatagataaatgatagcattcagtattcctttcaagcatggtattttgacaatggcgtgaaggacattttgggccacataattctgtctcatacattgttggatattctgtagtatccctgacctcttcccactagataccagtggcacccttggtttgtttccagacagtgctatatttcctatgggtgatgaagtcacccctgtttgagagtcactgtttagagtatatattttattctgtaatatatattaactcatttgagatgcctatttggagaggcatgtcttccaaggattttagaaaagaatttaaaattgtcttcaaatatttgaacatgttatttggactagttattttggggctactattccagaacacactggactagaattgttttctgttaaagtaccccttattaaaacttttgatcatatatataatattaaaaatagtattatcctcattgctattatattatgccattcatagagaatgaatgatgaggccagtgatgggggtatgttattttaataatatattctatttggaggttgagactttggatgagaaaggggaattcaggaatttaatcaagtactgaataaagaaccagagtcagagaacagaatttcactttctgaaccatcacttaatatagttgtttcttacccctgacctaaagctcatgcattattccttctgttatcttcctgtcttccctcacccctactcctagcccaaattaattgtttcctaagtgttcccccttttcttcctcaattttgtttatctaagcacttacaatctatattttaattttttcttccttctaagttgtgggataatggagtgctgggttgaaaagtggaggattagaagggcgttacagtggtaccactggctacctcaagaagttatttgatctagtcattgtcttcaaccagaacggaaactatcaatatcttgtttcttagtggcttgtagagactctccaagtacccatggtaacttttttttcatatctaaagccattaagcaaaattttatttcttttgttcccccttgtcttaaggcaatttagggttagttttttattgcattagagtattaggtgaagttgagtctcttaaagaaaattccttgtattcctggtaagaattcctccttcacctttcagcttcattctcatatacattaaaatgctttcattcagattctttaatcatagataattttatgaactatccattgaatttcctctgattttttaatattcttttcggaataaggatgcatggttccactaaactcttacttatctggtttgtggcagagaatgagacctatagaagaaaatttaaacttaaatgaacagtgctggcaatttacttgttgtggttgtttttaaataatgcactggtcctacaaagtgcttagaaaaccttacttaagggatcaacctgttcattttaagtagtgttgcttgtcattgcgttactcactagtcatttactacagtagctactacattgacaggtaaatgaccatagaactgtcagcctgtgtagcaacactacttatagactacttctagaatcttgcagtttagagctgtagagcagccaagatccctttataaggaacatttaaatagacttatgttctcattagcataaacaccactagtagttgaactggaatatcaattttaaaattctgaattgctaaaaaactgatactttactagtaaatcaagaaaaaaattaaaatataacctgtaagggccagttggttagttatgttaacaacatatgaaatatgtaggttgcatttgtgcatttttgtacaaatcaatacagtaaacttcttagtacgttttgactttggtgatgttggtttggtgtaggttaaattgtaaaatttaaggttggaaatgaaatctgaaagctgctgcaaaaataatggaatttaatttaaagtattgcatgtttacatgagacagaaggatacattgcatgatcttacagcattttataggtggttgacaagaaattgtatttggagttcaacgttgtaactgcatagggataactttagtaatttaagataaaggaatacttaacacagtacagcataaattctgttttgtttaaggaatttttaaaaaatttatctcaaaatcattttttcagaaatttgagcatctttgtaacaacagtttggctgctccagaaacgtagaatagagctttgtttttatttattgtagaaaattgtgaatttaatggggtttcttataacatattgataaatcagacagaaatttggccagtcttatgttctgacatccaaaactatattaggtgaactcagtgtaaagactcattggatcatttaaataatagactgtgacttaggttttttcagtatttgtcttgtggttcataaagaaaatggctaaatagtaaacctgagataattggattaaatgattatttttaacaagtcccaaacatttgcaaggaaatagaaaaatcaggaattaatgttaagatttatagttactatattaatcttttcatatatggccactttatgcaagtaagagaacagttaatttttttttgttcaatcagttcaagtgttttagatcaaataaaatattcttttatatattctgaagaattaattcagtacattctctgagtgtcccaagaggtacagtgtggaaaggatgtttatggtgatttacttgtaaagtaaatgttacccttactctgcatcctcagttcagtgctttacgtacagtcataggctattcttcagaacatccttaaaagcacagtacagaaaacaagatgaaagttttagattaagagactttattcattttcttccagactctccctaataaaatttcttctgaatttcccatatgaattctaaacattttaaatatcaggcttctaataacacttttttgtccatttatttatgttgaaattctactggtattgcattaatctcatgttgataggaaaggataaaaagttggctcacatgtttttttatagcagggtggtcaaatataatagtgttgcttatttttcttaatgatgaaatagtaaaatgattccaaggcctacttagagaagagcttagacttcagacagtgctttatctacatgagggagtaatcataattcttcagacatgtaagtatcagaagtctttttaaataatagtacttagtctatttaaatagtattaggttactggcagctttgtagtgagagtttgaatttttgtagagtttatatattttagacaagaatctgacatttagaaatgtaacattattcttaaattttaaaattgtttttatctgaagggggtcagggacatgtaaaattaatgcccaggaaatctgtttttggagaaagatgtgcatgaaaagtaaaggccacatatatggtgatttttaaactttactttcttttaatgaaacattttcttttgaggtaattatgtagattcacatgcagttgtacaaaataatacggaaggatcctatgtatcttcttctcagttttccttaatgataacatcttacaaaattataatataccaccccaaccaggatactgacattgatacaatacatagatcttgttcagatttcccctgctttactggtattcatttgtgtttgtatgtatttaattatatgtagttttatcacatatgtagattcatgtacctaccaccatagtcaagatacagaatagtttcatgactgtaagaatcccttgtgttacccttttatgtccacatctactttccttctgcttcctcctcaccatccactctaaccccaagtcttaaccactggcatctactaatatctctatgtctccaattttgtcatttcaagaatgttatgtaaatagtcatgtaatatataacctttctgggattggcttttttcactcagaataattctctggatgtatacatgtatgtatcagtgtctagtgttttacacaatgtttttgaaatcgtttgtcttgtgtatatcggtagtttattgttttgaattgctaaatagtattccattgtatggatacagtacagtttacttcttcattctactattgatggacttctgtattgtttctattttgtggttattgtgtttaaacctgctataaaattcttttacaagccttttgtggacatatattgtcatttctattgcatacatatttagaagtggaattgttactataaggtagttgtatgtttaactttataaaaaactactagactttttttccaagtagttatatgacttaaactctcccaccaacaatgtgtgttacaatgagaatgacattgttccattcatatctttgccaatattaggtgtagtcattttatctgttttactaagcttgaaatgatatctcattcttgttttaatttgtgcttctcagtaactaataataataatcttttcatccttttggcatttcagataccttcctttgtgaagtgtcttaaaagacttgaaggtcgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcgtgaagcgttgttgaattttgtcaaaggccttttctgcatctattgagataatcatgtggtttttgtctttggtcctgtttatatgctggattacatttattgatttgcgtatattgaaccagccttgcatcccaggggtgaagcccacttacttgatcatggtggataagctttttgatgtgctgctggattcggtttgccagtattttattgaggatttttgcatcaatgttcatcaaggatattggtctaaaattctcttttttggttgtgtctctgccctgctttggtatcaggatgacactggcctcataaaatgagttagggaggattccctctttttctgttgattggaatagtttcagaaggaatggtaccagctccttcttatacctcggtagaattcggctgtaaatccatctggtcctggactctttttggttggtaagctattgattattgccacaatttcagctcctgttattggtctattcagagattcaacttcttcctggtttagtcttgggagggtgcatgtgttgaggaatttatccatttcttctagattttctagtttatttgcgtagaggtgtttgtagtattctctgatgatagtttgtatttctttgggatcggtggtgatatctcctttatcatattttattgcgtctatttgattcttctctcttttcttctttattagtcttgctagcagtctatcgattttgttgatcctatcaaaaaaccagctcctggattcattaatttttgaagggttttttgtgtctctatttccttcagttctgctctgattttagttatttcttgccttctgctagcttttgaatgtgtttgcttttgcttttctagttcttttaattgtgatgttagggtgtcaatttcagatctttcctgctttctcttgtgggcatttagtgctataaatttggccagggcaattaggcaggagaaggaaataaagggtattcaattaggaagagaggaagtcaaattgtccctgtttgcagatgacatgattggatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccactcacaattgcttcaaagagaataaaatacctaggaatccaacttacaagggtcgtgaaggacctcttcaaggagaactacaaaccactgctcaatgaaataaaagaggatacaaacaaatggaaggacattccatgctcatgggtaggaagaatcaatattgtgaaaatggccgtactgcccaaggtaatttatagattcaatgccatccccatcaagctaccaatgactttcttcacagaattggaaaaaactactttaaagttcatatggcaccaaaaaagagcccgcatcgccaagtcaatcctaagccaaagaacaaagcaggaggcatcatgctacctgacttcaaactatactacaaggctacagtaaccaaaacagcaaggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaacactggctagccatatgtaggaagctgaaactggatcccttccttacaccttatacaaaaattaattcaagatggattaaagacttaaacgttagacctaaaaccatgaaaaccctagaagaaaacctaggcattaccattcaggacataggcatgggcaaggacttcatgtctaaaacaccaaaagcaatggcaacaaaagccaaaattgacaaatgggatctaatgaaactaaagagcttctgcacagcaaaagaaactaccatcagagtgcaggcaacctacaaaatgggaaaaaattttcgcaagctactcatctgacaaagggctgatatccagaatctacaatgaactcaaacaaatttacaagaaaaaatcaaataaccccatcaaaaagtgggtgaaggatatgaacagacacttctcaaaagaagacatttatgcagctaaaaaacacatgaaaaaatgctgactatcactggccatcagagaaatgcaaatcaaaaccacaatgagataccatctcacaccagatagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctatagagacacatgcacacgtatgtttattgcggcactattcacaatagcaaagacttggaaccaaccgaaatgtccaacaacgatagactggattaagaaaatgtggcacatatacaccatggaatactatgcagccataaaaaatgatgatttcatgtcctttgtagggacatggatgaaattggaaatcatcattctcagtgaagtatcacaagaacaaaaaaccaaacaccgcatattctcactcataggtgggaattgaacaatgagaacacatggacataggaaggggaacatcacactctggggactgttgtggggtggggggaggggagatggatagctttaggagatatacctaatgctaaatgacgagttaatgggtgcagcacaccagcatggcacatgtatacgtatgtaactaacctgcacattgtgcacatgtaccctaaaacttaaagtataataaaaaagattcctaaggggaaaaaaaaaaagagttgaaggtcttttgcccattttatgttaatggtttgtctttaattgaattgtaagagttccttatatattctgaatacaggtcagctatatgtgtgcataatatattttcttagtcttttctttgttttttctttttcataacaatgttttacaaagaataaaattttaataccttggtaaattcacatttatcaattttttagtgattagtgcttttatgattagtgcttttttggacttctctatgaaatccaggatatccttctatattttcctctaaaagccttatagtttagcttttaattctatgattcaaaaaatcaagttttataaatagttgtgaggtagagatcaagtttttgttttttttttctcattcatccagttattaaagcatcatgtgttgaaaagactttccccattcagtgccctggcatgtttgttgaaaatcaatagacaacatatgcatgattttatttctggaattctattctggttttttaatctgtttgtccatggtcatgccagttaccatggtcttgtttgctggggctatataccaaatctttgaatcaggtaatatgagtcctctaattttgctatttaaaaagattatataaagtactatgtgttttttgttttctttctatattttattatcaactggtcagtttctattaaaaacacctgttagaattttgattgggatttcattgaatttgtagataatcttgaagaacaaaatggacattttgacaatattgagtctttaatccttgaacgtagtgtatctcatcatttttttgggtctttttctcatgaggcttttgtacttatttcttgcgtactacattccattttattctttatataatctgttagggtacccacagaatatttttctataaggatatatttatatttcaaaatttatataattatacttactgagaaaataagatgtgacttctaagaattgacagttttgacggtatgtgattcacatgttaaagcctcttctgagcacattatatttaattttagcttttattttgcctaacatataaaaatggattcaatgttatagttaatgaaaacaatgtcagattattttgttaccttatgttgcttatacatggaagcattattttgaaattcagtgtctctcaatcgtttatatgttgcagaattttattgttttgaagcttagacattcttataatttttattaattaacagaggttgttaccatgataaaattttagtatctttgattaataatgaggtccattacatacaggaagacatgtattctcccactctatctgtggtagatcagtgattatttcttttttattatgaggtatgtcagacatgcaaatagagaataatataatgagtatcacagatcaaaaagaaagtcaattttttaatttcctcatgatgatctttctcctgtttcaccatatcagagttggacactattctaaagttagagattattattcctgtgcctgtaaatacttttagtatacatatgtatgcacatatatatgtatcattttaaaaatatttaagtttcatattgttttgcatgttttgatttgtttgctatttgtattcttttgaacatttatttaatattaagtttggaagagtttttgtattaggtcgttcttgcattgctataaagaaatacctaagactgggtaacttataaagaatagaggtttgattggctcacagtaggctgtacaggaacgtgatgctggcatctggttgacttctagggaggcctcaggaagcttaaaatcgtgggggaaggtggaggtggagtaggagaaagagagaatggagggggagtgctacacacttttaaatgaccagatctcatgagaactcactcattatcatgaggacagtacacagggagatggcactaatccattcatgagaaatccatcccatgatccagtcacctcccaccaggccccacctccaacactggagattacagtttgacatgagatttggtggagacacagatccaaaccacgtcagtttttttttttttccagtttttttcaaacaagacaggctttatttaggtcactaaaagtaatgttttacggaaagggaaccataacattgcacaacaaagtatgctgtaaaatctcaaacaagaaaggcagtgctttctttaggtcaccaaaaatcatgtttcactgttagaagcaaatgtatagctgcattttttcccccaattctctctataatactttgagactactttgcggtttccaaatataaactaaaatttgttggacagagttgctcagtctcatcaatagaataaaaatagcttgcaaaaaatttttgtttaatgccaacaaataacaaaacaatgtggtttctgcttactaactccaacatctagtgaaatggcctaacctatgtatactttcatgaacatttcactgtgaacgcagttgccctttttttctgccatcacagatagcctccttagtagcaagtatcttgtcagagcactttcggacacccaggaagtaattcctaacagaataactatagttatgtgggcaactgaaacaacagggcccacctctgccagagtccccacgtggtgttgcttttgtgctctgggtaaataagacccagcaccttgttagttggaacagttggaacccagagtgcagagctagatggaggagttgttgttacagacccatcaacactttaataaattgccgggggtttctaggtgctatagtatgcctcataggcagcaacataagccaactctgggaagaaatcatcatggtatatattctgctaaaaacttcagaaaagatcaaagtgtttcaataaagccttcagattcttctcagactaggacatgtttccaaggatttctggaagttttaccaaaagtcacagcaaatgttgtgccccataaatgtgaagggggtggaggtgtctggtcacctgggtggtaattatcaggcacaagcttccacgagaggacctcatttatttaattagttcttttcccttcaaagccagtaaatgcagcactttcttccttgctaggaggctgaggaatagttgaagatgatgcacaggtgttttgttctccaggttcaggagcagcctggggcatgctagtagatgtggcctgctgctggcacttgggcgaggtgacgcctgctctcagccagcctgttgcagttggtggtgtggcacgcggaccgcctcagagcctgcaatgcttccggcttggctttgtgccttttgtgggtggctggttcagctgtggttgtctgactctctgtggactgtggtgtggatggattcaacaaaggtgggctgggagagagctccccctggctcattttattgtctgtggtgctttccgtaattgaaagaaaacacttagctgaagtcacctttttatactgagcttattcccatggatagattataactgatgcggtagtgtaatcaaaggttattcttaacccatccaccatctccttacaaaggtcagcattcttttctgctgggaattattataatgcaccttcatgttggtgtgccgcatagtgtggtggtggcaaggcctctcactggctgaaaaagctgtgttgatagcaaaatgcttctcgtaggactccaaaatcattatgatgttggtctgtcgtggaagtctcattaactgtttccttctgttaatgtagtaacgatcactctcaagctgcttgttcagaacttcggggatttctatagttaatattctttcttccatttccctttctgtttacagctccagttcttgcacttaagtctcttcttcaataacacttccttcacttatttttcatccttgtcttcactactgttggagaactgcttattgaattttcagcattttcatctttgtcttcaactggggggcttttttagacagatttgatgccagacagcctgcagcacttccttcttcctgtgcttctcaggtgagctgcagcttttcttgccaattcatgctgtcatccttgatttgcacctgtattacagtgtacgtgatctttggctgcccatctatcacagcttccgttccaactattaaaatgtattagatattctgggatctttctgccttttttgtctttcccaccaataacatcagcaatctgggtcaaacccccaggcgtcccaccagagcccacgtggcactgggctgcacaggaggaaagaagatttaacgcaaaatagagaccatagtcaagaggcctcctccactagctgcaaggccaaaccgcagcctggcctggacagcgcagacacaaggctcccgactggggctgggagagttttccattttgagttctataattcttaattcaggcacttaattgctatgtagtaattccagttttatgaatacaatgtactgcaattatttttattgctgatgatttatttttagaatttggtaaaacaattttagattgtatactctttattatttaaaaaattactatttttaattgacaaatcataattgtatacatatatggggtatagcgtgatgtcttgatatttgtatacaatgtggcatgattaaatcaagacaattaacatatctgtcatgtcgtttacctatcctttttcatggtgagacatttgaaatttacactcttcattattttgaaatacatactacattattaattgacttcagtcactttattgtacaatagatctcaacacttatgcctcctctctgtctgaagctttgtactctttgttcaagaatttccattccctctcttcacatctttctagcctctggtaaccatcattctgtgctacttctacaagttcaacttttttagatttcacatacatgtgagatcatatggtgtatctttctgtgccttgcttatttcacttagtataatgtcctccaggttcatctatgttgttgcaaaatgacaaatttttatttactttttaaggctgaatagtagtctattgtgtatatatactgcattaaaaaaatcagtttatccgttgatagccagttaggctgataccatatcttgtctattgtgaatagtgctgcagtgaacatggcagtgcagatatccctttgacatatttatttcagttcctttggttatatacccagaagtgggattactgagccatatggtaatcttatttttagttttttgaggaacctccataccgttttccataatggctgtattaatttacatctctagcaactatgtacaagatttcccttttctctgaatcctcactaatacctgtcatctttcatctttttgataaaagcctttctaatgggtattaggtgacttctcattgtggttttagtttgcatttccctattgattagtgatgctgagcatttttttcatgtacctgtttgccttttgtaggtcttcttttgagagacacaaatggcaaatgttcaggtttattgcccatttttctttcttttttttttttttgagacgggagtctcgctctgtcgccaggctggagtgcagtggcacaatctcggctcactgcaacctccgcctcccaggttcaagtgattttcctgcctcagcctcctgagtagctggcactacaggcacgcaccaccatgcccagctaatttttgtatttttagtagagacagggtttcaccatgttggccaggatggtctcaatctcttgacctcatgatccacccacctcggcctcccaaagtgctaggattacaggtgagccactgctcccggctgattgcccatttttcagttaggttgttttcttgttattgggttgagttttttatatattaccccttatcagatatatgctatgcaaatatttttttccattttgtgggtttgcttcactttgttaattgcttcctttgctgtgctttttagttcaatgccatgcatttgtctatttttgtggttattattgcctgtgctttaagttgcagaatacaaaatcaacgtacaaaattagtagcatttctgtacactaataacaaactatccgaaaaggaaattaagaaagcaattcaatttacaatagcagcaacaacagcaacaacaacaaaagtaggtataaattaaacccaggcaatgaaatgtcttttcaatcatttaaaattgtaaaaccattctgaagactatagaacactgatgaaagaaatggaagaaaacataggttaatataaagatatcctgtacttatggattgaaagaatcaatattatgaaaacatgtgtactatccaaaacgatttacagattagtgcaatccctatcagaagtccagtgttgtttttcacagaaatagaaaaaacaattcttacaaacccacaaaagacctcaaatagccaaaacggtcttgaccaaaaagaacaaaatgacgatatccaactctctgatttcaaaacatataaagctattgttatcaaaacaggatgatactggtataaaaacaaatacattgatcaatggaacaagttagaaggcctggaaacaaacccactcatttatagtcaattgattttcaacagagatggcaaaaatgcataatgaggaaaggatagtctcttcattaaatgttggaaaaactggctgtgcacatgcacaaaaatggaattggatccttatctcaaaccatatacaaaaatcaagtcaaaaatggattaaagacatataaaacctgaaactgtagaactactaggagaaaacatagggaaagctcctcaatattagtctagacaaagtatattgtttccttattgatgtgttttcgaatttctcttggtctatacttaggttgaaattgctgagttatagggtaggtatgtcttttactttattggatattgccaaattactctaaagtagcagtaccacattatatttcctttagaagagcaagagacttcttgttacttcatattatgtcttcacccatatttgtattgtgagacttatatggatttttgctgatctgaatgctaagtcattgcaggtttattttgcccttccctggttattagtgaatttgaacttttttttcaggttactcagatgttcctctttttttttccagttagtttttttcttctcattggtttgtacaattttttatattgcagattctaattcttggcaattatatgtgtggcttgctttccaattttttatataatgagttttgatgcatgggaaatttcagtattaaagtagtcagatttatctgtcttttcttttacggtttgtgttttgtgtggcttgttgaagaaatccttttctaccttgaaattttaaagatattctgcatattttaaaaaatattttcaagttttccaagttttcctcttttcatttaggaattgagtcttgcccatctcattctttggtgttagttaggaatcaatttttttccttgtatggatagctagttctccttgtacaatttcttgaataatttatcttttctccttaacctacaaagccatcattgctatagtatgcaatgctaggtatgcaatactatagtatgctaggtatgcattgctctgtttctgagctctttagtctgcttgcttttctttttccttatttttataccgatgtcttaattactgaagtgttatagttcttggtatcttctagagcaaatctgcccaccttaaccttctttttcaaaatcaggggctggcaaactatttctataaggaccacatagtaactattttaggctttgtaggccatacagcctttattgcaactgctgaattctgtcattgtagtgcaacaccaaccgtgggctatataaaggaatgagtttggtggtattttgtgtaactttcacatatacacattgttatatattttttctttttttcaattatttaaaattgtaaaaccattgtttgtaagccatataaaacagtgagtagaactttgacttttacttaaaattgtctgtgctatttttttatgccccttttcttatatacactttttgtgaagttaagcttcttattttccctacatgagcaaaaggttatttaaaattcttcagtcaccagtgaaataatgaggcaggagaaaaagttctttaggtggtagtcttgtcatcaaaaataaatacagttgcatggaactgctcaagatctgaatcaaactgaaaaccggaaggcaaggggctgaaaattaagaacccctccaaccatgagttattcttcaggtcaagggaggcgagggcagggagaagtgtctagccatgccatcttagagcagaaggccatagctggatcagatccaattctcatgacacacacaaggaactacacttgtggcacctgagctggattcagatagcagagtgggcaggcaggtgggcaggcagagcagtggttggatgagcttagagctcagtactatagctccatcattctgttcagagcactgccaacatggaaccattgaatcagggtcttgtagaagttcgtggttcaggaggatggtttcctgaatcctcttggagttcttgatgatacatttgaggggcttgacagggcaaagcctttccagccttggatgatgagattacacgcagggtagatcttatagtttgtcatgtcagtaaaggtaagggacagcaggttggtttcttgaagctagtttcctggatcctggtaaagctcttgatgatgatgccctgtctcccaaggtggcagggttctagtggtatatgctcccagcttgccatggctctcatctctgataaccatctatctgatggcatgtttcttacagtagtgggccttctcctggtgacaacattacctaaggagttggcatttattgttttcagtgtttatggcaccaataagcaggttattggagatgttgtactggtgcctcaataacttgaaccatatgccaatattcaaaatgtagtgagtggtatgcttccttttcacttttgtaaggatatgtgaatctgtaggtcatccaggtctttgccttcccacttgtcaaaaggctccaggagctgtaggcacttgttgggtgtgctcatatccaccctctgcctactgatatccttgtggtaggggtgctggtagttgtccttcctggagtcaactctgcttagggaagctcatctgcatctggagcctccaatttgtacttcttcccatacatggttgtcaggaagtaaatctcttggttgaagttgatggtgacagaaatggccagggcttgaggatctctagggacatgatgaaggcttgggcctcaggtttgctttattgtggcctgtcaagttcctcttgtaggaggtgaagattgcatttttctccatctttattatgtcctacctgttccactggccaatgcaggggccacagacagtggccaggacaatgcctgccatatcctatgggatctgtgaataactcttatgctcaatattagtgtagatctgcttagatcccagtgctgtggtgagctgtgacttgcacttgagcccatgagctagcacttgcttggccatagctgttgagcacctgatgtcctcatagcttgagttggtacagctgttgatcagacccactttgatgtccaaaggccatccctccttctccaccacagtacctacttcttccacagtgtgggctaggtcggggtaaagggcttatttacatggggcttcagcttgttgaggttaatttttacctgtcatttataatggcaatcagggtcaggtaccaagtgatccttgattttatcttggattggcattgtctccttagcctgtcttacccagttattgctttattccgtggttctaagagaacactgagggccccaatttctacacccgtgttcagattatcatcaggccaatgtatgagatgggctgtatgctaggctgctggtactccacagtacgcgtgtgccaccttcaggatcacatctgtggatcagatctagcttgagattgtgcctgtcagcttcacaccattcatcttgtggcacttcaactcctaaataatttcaatcctgccgtccactgcatcagcctccccagctccagtgtatatgctctgcaagccaccactattgaggtgtgggagtagtggaataagaagaatcctggggtatatgtagctttcaagaatgatctggtgattgattctaggtccatcttctaaaagcccacactgtagttcacatctgcagttgctaggaaattatactttctgatttatgtccttggcctggcacagacctttcttttccctgagctgagccttgtctggtgatcacagtggatggtggatgatatggccatttggccacctctctgcttatgaactgcactgtggccatacggtccatagtatcctgaatgcctatgcaggtacatcttactctgttcagttgcctggggtcatctaggtatccatacatgatctccaagaggatcagagcctggttcaatcattcgttaacactgttaattttcttttctaggaggtcatagtggatatacttgttgactccagttagctcatggtcaccttggccttttggcacaggactgatgccacatgatatttctgcacactggagggctttctgcaacagggttactaatagagtatgcctgccataagagttctctatttcgtacaaaaatcaattttatggcctatgtttttaagttgctaacaaaataaactcgctttctagcccatatttagcacattgcatttgtgattatagatgaaatcaagattgttaaataaagcagtcatgaaaataaacttttcagatgacatgcaaaagttatttgttttacctctgcagtgctaaacatcatggacataaattagatgatgttagtttccctgtggaaccatttaaaacaactatctattctaaaagtcaaatatggtgattttgatcagaggattagtgttgacattaacattttaaagtttgctttaaatgatataaaattggtcatatcattttatcttcatggaataataaagtacaatcattacttataaggaggaaccacctaacaaatgcctttatttttcagtaatttatagtgttttgttcttaagtataaatcacttgtttcctgccataattttaatgatacaatgttaatatatagttaaaataatttattttttttaaacgcacatgaaattgaattggaggagtttttttgtagcatgaaaacatgctgccaattgcccactttgaatattattctgagaaaatttataacacttcaagtatgtcagtttttcatacttgaaatggattacttcctgactcactaaaagaatagaaatatatttttaaaggatatgagatattttttatatttgaaaatagcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgtacccgggaggcggagcttgcagtgagccgagattgcgccactgcactccagcctgggcgacagagcgagactccgtctcaaaaaaaaaaaaaaaaaaaaaaagaaaatagcatgctttttctttcttttactactcagactaatagtttcttattggaggtacaacttaagatcccccacaaatgtaccaaaaactaaatctagaatccataatggagaaaatcacatttagcacagtatgtattttatgattagagttgccaggtaaaaatacatgatgcctggttaaatttgagttttagataaacaacaaataatgtttgggacacgcttttattgttaatctgaaatttgaatgtagctgatcatcttgtatttttatttgctaaatctggcaaccctaattatgattcagtgtttaaaaatatataattatagatacatacttttctataatcgttgaaaaaagtcttcgagaatatgcagcagaatattaatggtggctgtttctggtggttagaggggaggaaggaagattttaaatactttgtattctctacattgtgttaatttatttcagtatatacgtattttttatacttaagtcacttgttttcggtggagtggcaaagatacagtggatggcaaaaatatatagaaatatctgatacttaaccatcatagagcatatgagtgggaaggacaagaaatcacacatataaaattgcgattgcagtaaacatcacagaagagagatacatcagtgttatgagattatacagtcagaggttctgttggtttggaagatcacagaaaactttcttcaataagtgaagtttgagattagatatgaaggaattcgtgtaggcattaactcggtcaagatgatggcttttcaaacagaatgaagggggagaaataatttggtgagtaggaggaagtaaaggaggggagagagctccagagaaagtagtgcaagataatgctgtagagaaacatagtggccacaatctgtggagacttgtgttccgtgtaaggtttcaggttttcatctttaaagcaatggtaagccattgaaaggggcaatactggtgttaacaggatcagaatgtgttttgcgaagatcattttggttgcagtgtggagaactggtatgatgagtaaatgtatgcatgagagtgagtgttgcttgaccagtaaagagaatgttgtagcagttcttatgagagagaaataggagtttgatcttagtagggaggtttgatgataatttaggaagtaaaattttcaggatttagtgatgctgttgatatgtggcagtcaccaagtgagaagtattaaagttaacatgggtttctgatttgcacaaagatgcaatgaaaaataatatagccaataaaaaatttaaagtaattacatagataaataggttagcaactaaaataaatcacttggataggatttgtaaagtgaaactgtgtgatggcaggaggtaaatgaatcaggagattgtaatatgaatatgcaatatgtaattataatatgtatatataatatgcaatatgaattatatatgatatgaattatatgtatatgtaatatgtaaaatgaattataatatgtagtatgaatcaggagattgtaatatgtaatattttgagttaccttgaaattaattttagttatttagtactgttcatattcaaatagatatcattttaaattataaaattatttcagtatttttagaataaaagaaatgcagtaatggtaaacaaaaaataagaagtgcagattttcttcttaacttttcccagggagacttcccctaccttttataatttattttattggagaaatagatttttgaattgaaaatgctattctgaaataaggccatttgccaacaaatcagtacctaaatgtatcttttctcttaattatgtttattttacagcatttgttgccttatgtcaggtttctctgtctctagttaatcaatccctttcatgtatctatcttttcctatacagattcggattagataattcctatgcttcaaaaccttttatggttctgaaaaggaaagtttaaacttaaagttaactccaactgtcaccttcttgaccagtttatattatgttcatttcttttctccttcctcaagagagagagagagagagtgtgtgtgtgtgtgtgtgtgtgtgtgtatgtatgtgtgtgtgtttattttcatttcttggtatcttcgaatgtgttcacctttctttctggaatccctttttagtctggaaaatactggctgagctttcttgacacagatcaaacattacctctctcaaaatgtggtcaccacctgggagacttaggaatttttgcatagcgtttcatttatacttattctattattttattatataataaattactagtatcagatgtagtataaataacaaatatacatcttacttatactacatgatatcatgtgtacttgtttaactatttccattaaatgtgagttttaaggaaagctgacatatgatagttgttcagtaaacctttgttatgagttctgttaggatggagatgttttgctgttgtctgtggatggtagataaatggacaaataaattatcaaatatcttaatatccagaagggaaaagagacatatatattattaataaatcagtgtggtagtattatgagggatgaaagtactctcgggagtctggaagagagaattctcagtttatcttcataaaggtgcttggctgatgttaacctcctttagaataaagctgtaactgcttaggcttgtgttatattaaatggatcatttttcttgccctcctcctgtggaatcatagcattccaacatttatagaggaaatagagtggaagctaccgaaatgggtccaccttcataatttaaaacttctaatttcaaagttataccagtaataggcagtcctccccttgagtgattttgtttccaataatttctaatgtatagagccctattaactcctattactggttgcaggcaggcattacacaaatgaaatgacctcatccagtttcttttctgaagagttccatcactttgttcctagtctgtttttttctgcagccatcttacacagcatggtgatctcttatgtcataaatagtcccatagagattattagaagaaatgagtggtaataagaataaagttgagttttaaaagatgaaagaaaaatgtatatgaccaggaaaacttgagctttgactaacaagtaaaagaaaatacctggctgggcgcagtggctcacgcctgtaatcccagcactgaggtgggcagatcgcttgaggtcaggagttgaagaccagcctggccaacatggtgaaaccctgtctctattaaaaatacaaaaattagccggacatggtagcgggcgcctctaatcctagatattcaagaggctgaggccatagaatcgcttgaacccgggaggcggaggttgctgtgagccaggatcgtgccattgcactccagcctgggcaacaagagcagaactccatctcaaaaaaaaaacaaacaaacaaacagttttttttggaatgtcttttccaaagggcaaattgtaaaaattgtatgcaataatagcatagtttgattaaatgctttttcttccagactttaagttctaatgaatttacttaaaaacaaacaaaaaacttattattattattattttttggagacagagtctcgctccagacccaggctggagtgcagtgtcacaatcttggctcactgcaacctccgcctcctagattcaagcaattcttgtgcttcatcctcccaagtagctgggattagaggcatgttccaccatgcctggctaattttttcatatttttaatagaaacaaggttctaccatgttggccaggctgtttttgaactcctgatctcaagtgatccacccaccttggcctcccaaagtgctgggattaccagtgtgagccaccacgcccgaccacactatgttcttgatagtcaaccatgtatcagtccttggaaaaaactgataaaagaaaagcagatgtagtgactgtattctgaggaaaattgcatgactgaaacttatgtggtgaaacatttaaccatgtagagttagaagaaacctcagtattctaatcctttgacattgtggagcagtgtgttgtaaaggattaagggattattaatttcaggacaaataaaaatcggttcatcaattttgaaggcacaccttacatgtaaattgaagtgcttatttgaggagatacattcttactagagcagacagacttctttcaaaaaaaaaaaaaaaacaacagaatacccagcacttgtttgcttatgttattacttattaagaaaaaatagcactagatgcattcctggatctgcttattgtcattccatttatttgaccttaagttttgccaaaattctgttttccccccaaagtgactgaacatatttccaaagaagtcttagatttcatatccttgatgaaggctcttcactgacttgtagcagtaaaaactattatgaaaaataaaaacttcgaagactacactgtattattatataatattgtctatgattttatgtaattgtgttttgcattctataaagctttatggtatataaatgtgtcatttataattaaatgtggttgaattgatttccaaaattatcagatccatgattaacaaaataacttgttgtattacccttcttgttataagaaaaggggatttaagtcttatttcctgattttgtaacatgttataactacaaataatccttgtttagggtaataaaaatagaaacatttgctttctgagacttggatagtatttggaaatatttgattcaagttgggaagtgatttttcactcttaatagttgaaaatttacaacttttagggaaaatcgttgtgagcattctactgtagccccctccccctgcctttttttttttttttttttttttttttttttttttttttggtatttcagagtctgtgctttctaaacaataaagaacaaatatcccaggatacaaagaaatgggaaacttaaaactaaaatttgctgtttcatcagattcctgagagtggttttaattttctatagatgtctttagtatgttcatgtgcctggaatttatataatttatttgttctaaaactgcataaaatttttttacatttagaaagcatgtcaaaattggatttttaaatggaaatatcctattatggttctgtttagaattttcttatatataggacaaactatattattttagaaattcattctggttatttatggagatgtcttttttagctgcctctattcagaattcaaagttattaaaataccaagaatatttagaatatttagtgaggccaaggctcaatagtgttttattttgtatttaaaaaatttctttgtctcgctgtattgcctaggctggtcttgaactccttggctcaagcgatcctctcaccttagcctcccaaagtcctaggattataggagccacatgcaaggccccagcagtctttggagacaaaaaatccagctctgattcgggcaacactcagagtggatttttagcctagggagagaaaaataaatgatataaaaaacagacaaacaaaaaacctagtcatgggagaaagggagttggagagtaagctttggaagagtactatctataattctgttagaacagaccttctgaaagggggcaaggagttttaactccattgccattatttgttggagaatataatttccctcaggcatttagggcaaggaaaaggttaagaactgctgtaccaattaagttctaataatctaagcttactctgttaacattctatctcacttagagtgatttttcccctttaatgtaaatcagcttatgccattcccctattaaagccccctcttttcatattgtgaattaaaaattccaactgcttttcttaacttaaaaatcccctactggctgggcgtggtggctcacacctataatcccagcactttgggaggccgaggcgggtagatcatgaggtcaagagatcgagaccatcctggccaacatggtgaaaccccgtctctactgaaaatacacaaattagctgggcctggtggcacatgcctgtaatcccagctactcaggaggctgaggcaggagaatcgcttgaacctgggaggcggaggttgcagtgagcctagatagcgccactgcactccagcctggagacagagtgagactccatctcaaaaagaaacaaaccaaccaacaaaaaaccctacctacctctctaaatgaatgtatgactctgccctttccttcataccaagtatgttcctatttagggctgttgttctagctgtgccttttgttttgcttggttgtcttactgttttgtacttgactggtcgtatgtcagctcacatatcagtttcataggcatttgtgaccactcaatattaatatgtcatccagttctcttttctattacttataattattataattatacttgtcacaatctgatgttttcttgtgtgtttgcttctttgttttatttctctattaactactatattgttagtgcttggcatagagttggtgcctaagaaatatttgttggatggatgagtgaatgaaccactgccctaggttaggggtgctacccacgtcatatcattgtatctggtgcaggtaatattatccacaattttcagaaactaattgcttatattataatttttattggggtgaaaatagaggcctaatattaacactgaaaaagaattttcaggtcgaagactggaaaactgatttaagtctcagcacttttacttgtaatttagactgtcactatacctttgtgactatgtttctttttctataaaataatatctcaaagagttctgagatttaaatgaaatggtgtatttaggagtttttcataaagcactaaataaattattttacattctctcctaccaccctaaaaaagaagtaaaatacttaaaaacaagcatcttgggcaaggcgcaggggctcacacctgtaacgttagcactttgggaggcccaggcagggggattgctggagaccaggaattcaagaccagcctggacaacatggtgagaccctgtctctacaaaattttaaaaaattagctgggcatggtgacacatgcctgtggtcccacctactgggaggctgtgctgagaggatctcttgagcccaggagatcaaggctgcagtgaactgtattcgggccactgcactgcagcctcagggacagagtgacaccctgtctcaaacaaacaaacaaacaagtatctttaccatttttttttgataaagtaattttaaaaggtgagctttacttttatattataattttactacatgtactatccaacgatggaagttaaaattaattactttggagaatctctagtattattgaatattttatgaattgcaaacttatagactgaatactttcttcaaccttttctgtattagctctttcatttctgttttacttcctttcctatgtcataatcatccaatttcctttgtatttatcctttatctattttgaaatctatttttttgctttctgaaatatttattatagaaaatgtaattaatttactagaaacatagatatatttattcacctctaggctttgaaaaccctgaaaaaataaagctaattcaacttttctacgttaatttcttctatgtgaaaacactacattcaatctaattgatcaactcctaagcacaattttccttttctgcatctgtattttcatgcaaatattattaaactgatcagaatgccctttcttcctctacctcacctattcagacctctatctccagaaagattcagttcatctcctttttcactgactttcccagcctgctgtatctgaagtggttgcttatgttttttataccatgtcaggtattatttgtaattaatcatattttaccctttttaatatcttatttttttcattaaccgttggtaactagtcattttactttttctattttattttgtggtttctgtcactatatgtttcagattaacaaactgttatgtttctaatagatctcaagctcttttaggtctcttttcatagcatctgtcccagcatttttattcattttgtgtgcctaataaagtttttttggtttgtttttactccccattaaacagccatttattttattccaaaaggaaataattgtgtgttttgtgagtgacaatattgtgatgtgttcagtggtatacttcttgtggccacattacttagatttgatcccccattttagtacttaatagctgtagggtcttagtaaagtcattcagcctctctgtgtctccgttttctcatctgtaataagaagatcttttagggttgctgtgtggattaaatgagacagtaaatgtaaaatgcttaacactttgttgtcaattaagtactaacaatcttcatcaacattagttaaattattttatggcataacggaaagaggcgcagaagtcagatagactgtactgcttatgtgaccatgggcaactttctttgcttttctaaaacccagtttcttcattggtaaaatggggatggtttattttgaggattaaatatcacacacacacacacacacacacacacacacaccacacacacttaatatatgtgcccagtgacaattctctttttgcatttgtattgctgctgtttttctgaagccagaccgctgctcctctgcgtccatccctcatgtctgtctgactgattaaaagcatcttgaggaagttttgactgcagcagttggtttggtgccttcagaagatgaattgtgaggaaactccatgtttttctaagagtccattacattcagaagatgagaactgaataaaaatgttaatctgaggaacagattttgggcagtatcagtgtgggtttcataatactggactatttaattataatttgtaccagtgtcccactattcattggtaaaggagtcttgatttgtgcttaataataataatatattcattgagtgtaaattagtgatttcatctgacagtagtgtaaagatagttgcttatagagttattttctttacacataaaataccgtaaccatatgagaagaatgtcaacacaaaccaaatatttattcgaaaagattataaattcaaaatattttctatacccagtagtcaaaaaccttcaaaaattgttaatgttttgctttttcttttggactagagattgtttcagttggtattcactctgaggggtggagagtctcactttaggacacatctgaagaatagcagacagttatgagaggctgttagcaccaccttgtggtgtctgctgtaccctgccttttacctttagtgccctgccattattatatagatcttgataaccagggaaagataagtagggaagacctcattttaacaattatcttttgaaagtacatgcaaattttgatgattgggtactgattactattgaatccttaatatttccgtaaggttttacgtgtaagatcttgcctattataataattgatttaagtgtttcagattcttaggtatatattaacaacatagctttgcaagtacagaaataatgttttaagactactctagtagatacaactttttctctaaattacattattataaataagtccttttttcttaaaattattttagaaattagtatttaagtgtggtgtatttgatgaattttttcttgtttgctgtcataaaatgcaaaaaatgtagtccttgccagtaaccttaaaacacaattttaatgttttttaacagaattttatagtcataaaataacattgattttagaaacaacattttttataacagagtattttcttccaagattctattttagagttttgtactttgaacagttggttccttaatgttattgtccattagcctatttttagatttttctaatttggcttgaaagcaaaatgtgtcattatattctggattgtggggtttatgtaatttctaataaatatttcaatgttcatgaagagagatgaacataaaggctaagaatcgtaagtaatgcagataccacaatgaaagacattttgtattttagacaacaaagtgaagtatatactagatatatgacatctttcatgtaattaaaaaaggtacaaatatctttaaaataaatttaaatttccaaagtttactatgttagtccaccttgtatatttgtaataaaattaaacaacagtttaaatgtagagttaaatagaattagcttaattcaatacgtggattaaccacatagtaattatacattgagtagtgtgcccattctaaatgaaaagtatggcctctacattagaatcagcgtacaaccaaaaccatgtgtattactatacttcattgcaaagaaaacaggatctctctctgttgcccaggctggagtgcagtgataagatcttggctcactgcagcctctgcctcctgggttcaaatagctctcctgtctcagccttccaagtaactgggactacaggcacgtggcaccatgcccagctaacttttgtatttttagtagagatggggtttcaccacattggccaggctggtctcaaactcccaacctcaagtgatctgcccacctcggcctcccaaatgctgagattacaggcatgagtcactgtgcccaacctgttttttttttttccttatctttctttctttctttctttctttctttctttctttctttctttctttctttctttctttctttctttctctctctctctctctctctctttctttctttctttctttctttctctctctccttccttccttccttccttccttccttccttccttccttctttctttttttttgttatggagtctcactctgtcacccaggatggagtgcagtggcacgatctcagctcagtgcaagctccgcctcccgggttcattccattctcctgcctcagcctcctgagtagctgggactacaggtgcccaccacctgcccggctaatttttttgtatttttagtagagacggggtttcaccatgttagccagtatggtctcgatctcctgacctcgtgacccgcccgtctcggcctcctaaagtgctgggattacaggcatgagccaccccacccggccatttcttttgaaaacattttgttataaacttgaagatacaacaaaatacgacttcttaatttatgtaacgttgttattttatgattatacttttttcatggacatataccggcttgagtatgatctactggcaagggcaaaaggtggtgtagctagtctgttacctaagaattgtagtgccactgacagaagtaagggaattaacaatggaagataattatgatatgtaagttaagttcttagtcattttcaaaaggttttcttgggtagattatatattctttcagggatattggttttgatttctataaataaaatatttattattgcatcattatttacatcactataggatattattgtcctttgagagaaatcatcactctcaatccgttcttttctgttctcttttaccaggcagtactgcttatgcccacaggctttaggggagacaacactgggattgacttgatatgtatagtaactttgaaatgttaccacttctcaatgatcctcagtttcctaatctgtaaaatgaagataatacctggcacatggtaataagcactggataaataatggctgttacttggaattatcattagaagagaatcagaatgatcttatcagagtctcattggaaaattcattagacactcacctgcattattgaggaactgataggtgttcagtgcctctcagtttttaggctaagaaaccataccttgtcaaatcaggagttagcaaatttttaataaaagaccagataattttttaggctttgtggcatggtctttgaatggtctcttttgaaactactcaactctgctgctttagcaggaaagtagaagcatttcctgctgttttagcaggaaatggagaaaaggtgtgttattttgtatggcttcctttaggcatatatagaagccagtgtccttaaagacctgctataaagaccagcttgattaaattataccccactcttgcctattattttaaccctactaggttttcattttttgaatgtgcctaccagagcactgtctctccttgcgcacaggacacactgagtcttttctcctctttgtctttctcttggaagattgttttgtaggattggttaccttagccagataattcaacaaacttttagtgctggaacatgatgcctgtataggaaagctgaaggcagaactatttttaggtctccatgtaattttttatctaagataatgatgattatgataataatgatggagtagctattactttttaagttcctactgtataataggcatgttataaatgtctcattcagtcttcataacaaccctacaagttacgtggtgttagtctcattttacatttaagaaatctgcagtgaagtgatttggtcaagaatacacaacaatcagtgccagatatgggcacacacctttgactccaaagtcttctgctcctctctgtttccattaaactttgaccatgactaggacattcgtttactttgttgtttttactaaataaatgttgataagggcagctattatattttaatttgtctttttttttttttttttttttgagacggagtctcgctctgtcgcccaggctggagtgcagtggcgcgatctggctcactgcaagctccgcctcccagtttcacgccattctcctgcctcagcctcctgagtagctgggactacaggtgcccgccaccacacctgctaattttttttatatttttagtagagcccgggtttcactgtgttagccaggatggtcttgatctcctgacctcgtgatcctcctgtcttggcctcccaaagtgctgggattataagcgtgggacaccgcgcctggcctaatttgtctttatgcctttagtttcattatagtggataactaataaacgttaatttagttaatgattgaataattgagggcagattcaatataaatgatgaagtaagggaaaaatggtcttatttgaattagaaggtctccattggaaatgtagtatgagtaaagaggaacatttaaaataaagtgtctttcctaaaacccattcagggcatttaggttttaaatgcctctccattgtgtgtatgcatcacattttaaaaatctgttcatctgctgatggccatttatgttgcttccaaatcttggctattgtgaacagtgctgcaacaaacatgggagtgcagatatctctttgatacactgatttcctttcctttgggtttatacctagcagtgggattcttggatagtatggtagctctatatttaccatttgtatgtcttcttttgagacatgtctactctggttattaatcccttgtcagatgagtagtttgcaaacattttcttccattctgtgtgttgtttcttcactttgtcgattgtttcctttgctgtacagaagtgttttaacttgatgtgaccccctttgtcgatttttgcttgtggggtattactcaagaaatctctgctcagaccaatgttttggagagttttctcagtgattacttttagtagtttcgtagtttgaggtcttagatttaagtctttaatctacttggatttgatttttgcatatggcaagagatagagggatggggtctagttttattcttatgcctatggatatctagttttcccagcaccattcattgaagagattgtcctttccccaatatgtgttcttggcaccgttgttgaaaatgagttcactgtagatggatggatttgtttcctgtttttatgcctgtgccatgttattttgtttactgtaactctgtagtaaaacttgaaatgaggtaatgttcaatttttttctttttagtcaaaattggtttggccattttgggtctgtttttgattccatattatttttaggataattttttggtttttctgtgaagaatgtctttggtattttgatagggattgcaatgaatatgtagattgctctgggtagtatggacgttttaacaatattgattcttctaatccatgaacatgaaatatatttttattttattgtgccttcttcagtttcttgcatcaatgttttatagttttcgttgtagaggtctttcacttccttggttaaatttatttctagttattttatttgtagctattgtaaatggggttactttcttgatttctttttcaaagattgtttgctgttggcatatagaaatcttactgatttttgtatgttgattttgtatcctgcagctttactgaatttatcagttctaatagtttttttggtggagtccttaggcttttccaaatataaaatcatatcatctgcaaacaatgataatttaacttgtttctttccaatttggatgccttttatttctttcccttgtctaattgctcagctaggacttccagaactctgtggaataatagtagtgaagtgggtacccttgtcatgttccagttctcagaggaagggctttctgattttccccattcagtatgatactagctgtgggtctgttatatatggcttttattatgttgaggtatgttccttctgtactctgtcttttgaggatttttatcaggaagaatgttgaattttatcaaatgctttttcaaaatcagttgaaatgatcatatggttttctccttaattctgttgatatgatgtatcacattagttgatttgcatgtgttgaaccatacttgcatacccaggataaatcccacttggtcatgatgaatgtttttttaattgtattgctgtattgctgaatttggtttgctattattttgttgaggatttttccatcaattttcattatagatattgtcccgtagttttcttttttttgtttttgtttttgagacaaggtctcactctgtcacccaggctggagtgcagtgacatgctcatggctcactgcagccttgaccttccaggctcaagtgaccctcccacctcagcttcccaagtagctgggactacagacatgtgctaccatgcacaactaatttttgtatttttagtagagacagggtttcgccatattgcccaggctggtcttgaactcatggcttgaagcaatccccctgcctcggcctcccagagtgctgggattacaagtgagagccactgcgcccgttgtagttttctttttttgatgtgtctttgtctggtttttgggatcagggtaatacttgcctcgtagaatgagtttggaagtattaccttctctattattgaaaatagtttgagtaggattggtattagtttttctttaaatatttggtagaattcagcagtcaagccatttggttctagacttttctttgctaggagactttttgttacaggtttgatctcattacttgctattggttggttcaggttttgtatttcttcatgcttcagtcttggtaggttacatgtaacaaggaatttatccatttcttctagattttctaatttattgttatatagttgctgatagtagccactaatgatcctttgaatttctgtggtattggttgtaatatctcctttttcatctttgattttatttgtatcttacctttttttttttctttatctggctaaaactttgtcaattttgtttaccttttcaaaaaatcaatattatttcattgatcttttgtattttcttcatttcaatttcatttatttctgctctgatctttattatttcttttattctactgatttcagatttgcttgctcttgcttttccagttatttaagatatatcattaggttgtttatttgaagtttttcttatttttgatgtatttgtttatagctataaacttagttataaactcccccttagtcctgcttttgctgttttggtatgctgtttccattattatttgtttcaagaaattttccaattttcttcttcttcttcttcttttttttttttttttttgaggcggagtctcgctctgtcgcccaggctggagtgcagtggcacgatctcggctcactgcaaccactgcctcccgggttcaagcgattcttctccctcagcctcccgagtagctgggactacaggtgcacaccaccacgcatggctaatttttgtatttttagtagagatggggtttcaccatattggccaggctggtctcgaaatcctgaccttgtgatccgcccccttcagcctcccaaagtgctggaattataggcatgagccaccatgcccagccctccaattttctccttaatttctttattgatctactggtcattcagggacatattgtttaattttcatatgttcccatgttcctcttgttactgatttgtagttttattccaccatggtcagagaagatgcttgatattatctcaggttttttgttgttttttttttttaatgttttaagacttgttttgtgacctaacatgtgatttgtccttgagaaagatccatgtgctaaagagaagaatttgtattctgtcgccattgaatgaaatgttttgtaaatatctattaggtccatttggtctacagtgcagattaaatctgatgtttctttgttgattttctttctgacagatctctccagtgctgaaagtcgggtgttgaagtctctaccttttattgtgttggggtctatctttctagctctaataatatttgctttatatatctggatgctccagtgtttggtatattaaaatttacaattatatccccttcctgaatttaccatatatcattatataatgacctcctttgtctcttaaagtttttatcttgaaatgtattttgtcggatataatatagctactcccgcacttttttggtttccatttgcatggaatttctttttccaccccttcattttgtatttgagtgtctttatgggtgaagtgtgtttctgtaggcaatagatcattgggtcttgtttttttttgtttttttttttttaatccattcagccactctatgtcttttgattggacaggttagtccatttatattcagtgttattattgataagtaaagactttcttctgccgtttcttattgttttctcaattgtggtcttccttcttttctattttcctgtcttttttttagggaagttaattttctatgatggtattatttaatttcttgcttttattttttgtgtatctgttgtatgttttttgatttaatgttactatgaggcatgcaagtactatcttataacgcattattttaaactgatgacagcttatcactgcttgcataaacaagcaatcaagaaaaatgaaaactaacaaaaactctacacattaactttacccccttgctttttaactttttgttttttctatgtatatcttattgtactgtcaatgtcttgaaaagttattgtagttattgtcctagattggttcatcttttaatctttctacttaagagtagtttgtacaccacaattacagcattacagtattctgtgttttttctgtgtgcttactattaccagagagttttgtaccttcagatgttttcttattgcttaatgtccttttctttctgattgaagaaattcctttagcatttcttttaggacaggtctggtgttgatgaaatctctcagattttgtttgtttgggtaagtctttatttctccttcatgtttgaatgatattttcacaggatatactattctagggtaaaaggtttttcccttcagaactttaaatatttcatgtcactctctcctggtctgtagtttccactgaaaagtctgctgccagacatattggagctcccttgtaagtttatttgtttcttttctattgcttttaggatcctttcttcatccttgacttttaagagtttgattaaatttcataagattgtcttctttcggtcagatctggttggtgttctgtaaacctcttatacctgaatattgatatcttactcctggtttgggaagtcctccgttactatccttttgagtaaactttctacacctatatctctccctgcctccactttaaggcaaataactcttagatttgaccttttgaatttattttctagatcttgtagatagatgtgctttactcttctcttttttcttttgtctcctctgggtgtgtattttcaaatagcctgtcttcaacctcctgggttcaagctgttctcctgcctcagtctcccgagtagctgggattacaggcgtatgccaccacgcccagctaatttttgtgtttttagtagagacagggtttcgccatgttggccaggctggtttcgagctcctgacctcaggtgatacacccaccttggcctcccaaagtgctgggattacaggcgtgagccaccgcacctgaccatttggttccatttttaaagggattggggaagggagatgaaccatgccactccaaggagatttagttctaagactattgttaattattgggaaagaaagagaaccaagggaaataaaacctcagtaagaagactgttgttcttttcataaaatcaaatgtttttaaaagcctaattttattagcatttggtgcttggaccattctcttgaaaatgctgaagaaagagacatatgatagccttagtttttgtatcctgattctgtccttttgaccattccttaatttccttttcaggtttctcttataatttgattagcctaactgctttcttcactgtagttcagttgcagttctagctctgggagtcccccctaccccaacacacacacaatgttagcttatgtattttaaatgcttctcaatgtgtttatatgggtaaagatgtcccataaatgtccctaatttcccaaattaccatcttcatctttctcttcaaattcattttttttagtccatttcataaatgattgtaccattgtatcctctcagtgcttcaaactatttcttcctgtatcttaaatctatttagttatagaatattatttctgtctctaaaataaaatatttttagaaatctgttactcttttcagtctgacttttactatctcaggtcatgcctttgtgatttttgtcccaaatgccttaaataattttaaaaatagtggtgctaaatagtgtttacctattttgtaccccaaatcccccaatccatagtccatgctccattcatttttattttccttaaatgcacacttgagattttatttttccccaggtgtatttaagtctttagttgtatttcatgctcccagaataaaagattaactccctagaatgggcattcatgatctagccatattctctatgtatttttgctccatcctttcaaaactactcatgttcctgaacgtatcatacttttccttatttccatgttgttgcacaaggtggtgtctatttctgtgattttctttcctgcttcttgtatgattggcagaatccttctccttctttaggactctgcttaaaaatcgtttgtactgtgtcccttttcctttcattgtgaggcatgttaaccctaccctttccatagttttaaagttgtacctatcccttattttataattgtttattgctgttcctctttcccactatcaccacaagattccttgagaatgctattttcctttattcatctttgaaccttgagtcgctagcacaataatttgaacataaatgttagttaaagaatgaaagaaagggagagggaaggaagaggattgttatgttgaccaaattatatgcataggataaaatgaaatatatatagatttaaataggcaagtaagaccaatttatgacacctggtttaagccacatacatatccgcaaggcataggagtagagaacaccttgattgataatcccaataaactatatgtgattgtgaggcagtgggcacgagtctgggttctgtcaggttgtcctgtgtagaactggtggaagcccacacagaactggaataagaaacaatttaggcttacctggagagttagggttgtctgggacaaggggaaaggaatgcttgagagtatcatctactttgacacaggaaaaatgacacaggaaaaggctcttcataaaagataaagcagttgtttttagaatatatactcgttggggatactaacttcatgggctacaatgttgaaacaactagggttttaagtcatcaaatatgaggagtttcatctatagcaaaatgttaatattgattaataaaacttccttttcttctccctccttttttgttgatcctacagtgtccccagtgattctatattttttatataatccaaataaagactaaaggaatagcatacataaaatagtattaccctgaaacattggaaactagtccagaaaacagttttacctgtcattagtaatcacagtgtgtcttttattgagtactatttggagtattctttgatttgaagcatactttacaataactacttctggatgaaatggagctacactttgtaataactgcttggaaaattaaagacagatataataatatatttatacatttattcaacagattttgtattttttaagtgccagtcactgtgcttggcattggatgtaatttgaacaatacaaatggtctctgatatgaccttgcattccatccgaggaggtaataagcaaataattacattattataaatgttaataacaaacaaggtaatgtgatataaaagaatgggaaaacctaatttgatagggtgttaagagacagggctctctgaagagatcatagagaagtgatctaacctgaaggggcagcgaagaatttgatatattgaagggtagctggagtatggtcaacagggagagtgccactggatgagaattcagagagaggcgagaatcagcttgtatacagctttgtaggctatggtgagaagtttggatttaatttagattggtaaagcagtgtttaggcagaagaataacttaatctgatttatcctctaaatgcataaaatctgtagatgtctacatatattgagtgaagggcttttttttttttttttttttttgagatggagtctcactctgtcacccaggctcaagtgcagtggcgcaatctcatctcacagcaacatctgcctccagagttcaagtgatactcctgcctcagcctcccaagtagctgggactacaggcgtgtaccaccatgcccgactaatttttgtatttttaatagagatggtgattcaccattttggccaggctggtctcgaactcctagactcaagtcatccgcccatctcggcctcccaaagtgctgggattacagatgtgacctgctgtgcccaaccttaagtttttattataaaagtaattatatctttagtaagtaggttttggaatattaaaatatggaaagcagaagaaaaataactcaccaccaaatcacaaaccgcttgaaatttttttaaacatatatccttctaggtttttattctactgatacttatttgacatttattaaattgtatttaaaatctctgttaatgtcacaagaatgttatcattatcacatattcttcacaagtatctttaaaagactactaccattttgttacatggctaacaccacagtttgttgaaccagtcctcagttttggacctttagatggttctatgggaaatttttaatattaagcaatttatttccttagcatagatttctggaaatggaattagtaaaaaggtattaactttatagatgcaccatttattaaatagggaatccttttcccgttgcttgtttttgttgggtttgttgaagatcagatggttgtacatgtgtggtgctatatctgaggcctctgttctgttccaagggtttatatatttgttttggtaccagtaccaggctgttttggttactgtagccttgtagtatagtttgaagtcacgtagcgtgatgcctccagctttgttcgttttgcttaggattgtcttggctatatgggccatgtgaactttaaagtagttttttccaattctgcaaagaaagtcagtggtagcgtaatgggaatagcactgagtctgtaaattactttgggcagtatggccattttcgatattgattcttcctgtccatgagcatgaaatttttttccatttgtttgtgtcctctcttatttccttgagcagtggtttgtagttctccttgaaaaggtccttcacgtcctttgtaagttgtattcctagccatatgcagaaaacagaaacttgacctcttccttacaccttatacaaaaattaactcaagatggattaaagacttagatgtaaaacccaaaatcataaaaaccctacaagaaaacctaggcaataccattcaggacataggcatgggcaaagacttcatgactaaaacaccaaaagcagcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaacaaaaaacaccaaaagcaatggcaacaaaagccaaaatcaacaaatgggatctaatcaaactaaagaacttctgcacagcaaaagaaactatcatcagagtgaacatgcagcctacagaatgggagaaattttttgcaatctactcatctgacaaaggtctaatattcagaatctacaaggaacttaaacacatttacaagagaaaaaacaaataaccccatcaaaaagtgggtgagggatatgaacagacacttctcaaaagaagacatttatgtggccaacaaacatatgaaaaaaagttcatcatcattggccattagagaaatgcaaatcaaaaccacagtgagataccatctcacaccagttagaatggcgatctttaaaaagtcaggaaacaacagatgctggcgaggctgtggagaaataggaacacttttacacagttggcaggagtgtaaattagttcaaccatcatggacgacagtgtggcaattcctcaaggatctagaaccagaaataccatttgacctagcaatcccattactgggtatatacccaaaggattatgaatcattctactataaagacacatgcacacatatgtttattgcagcactatttacaataggaaagacttgtaacccatccaaatgcccatcagtgatagactggattaagaaaatgtggcccatatccacagtggaatactatgcagtcacaaaaaagaatgagttcatgtcctttgcagggatatgaatgaagctggaagccatcattctgagcaaactaacacaggaacagaaaaccaaacactgcatattctcactcataagtgggagttgaaaaatgagaacacatggacatggaggacaacatcacacaccggcacctgttgggaggtggggggcaatgggagagaaagcattaggacaaatacctaatgcatgtagggcttaagatctacatgatgggttgataggtgcagcagaccaccatggcacatgtatacctatgtaacaaacctgcgttttgcacatgtatcccacaacttgaagtaaaattaaaaaaaaaaaaagaaaaagaagttctgagcttttcattgtcaaagctgtctataattatctttattattttagtagtgtatattgtgattataaagtcagaggacaactttggaacatcttaaagcattaattactgactcatagtttgaggttaccattacatcttcctggtggattctgtgacaaatgagaaataagacacataagtcagatagaaggagataaaatgttaacttaggccgagcactgtggctcacgcctataatctcagcactttgggaggctgaggttcactttgggaaggatcacttgagctcagtagttcaacaccagcctgggcaacatagtgaaacatcgtctctgcaaaaaatataaaataaaaatagccgggtatggtggcacccctgagcctgagatgggaggatcacttgaagatgggagattgaggctacagtgagctgtgatcatgccactacactccatcctgggcaacagagtgagaccctgcttcaaaaaagtaacaaaaggaactcttctgtttttaccaacatatttaccctttgttcttcattccttctgtagaattaagtttatatctagtataatttcctttcaatctaaagcatttatcttatagtttattgtagcacaaattttctgaagacaaattctatcatttttattttgtcttcatctttgaaggacattttcaatgggtatagaaatctaggttgaattttttaacatttaaaatattctattattttctggccaccattatttctgatgagaaattatccttatcgtgatttccttatatgtattgtgtcttttttttttcttctggatgatttaaaatttttttctgtgtttggttttctgctatctgatgatgatatatctagatctggtttctttttatttattcttcttggggtttgctgagcttttttaatctattggttgatatatgtcagtttgggaaatcgtttttcacctctgatattatatttttaaaaatctaatattttcatttcactcttttttatactttctctctgctaaaatttcccttcaattctaacatattatctaccctttttaattatttgacatctatattattattagagttgttttaaagtccttgtttgataattccaatatctgggccacttctgggactggtgtattgattgtttcctctttttataatgagtcatttcttctggcttttttatatttcacagtagtttttaatgtaatgtcaaatgttgtatataaagagaatggagcctatgataaataatgtttatgtccaaaaaaatacatgcctcttcttttgtcatgatattagtatagttccgttggatctggtctttggcttttattccatacttgagctgtatcttattcttttaaaatttatattaagttcactacaggaccctgtgttttttgagagcaagattaggatctttgtttttgtatggtttgtagtttctgcttagttctcctgatacaccttcagaattccacatgccttgttcacttgtgccttagggaggtatctctcttagtgcttctttctttctaccagacacagattgcccttcctggtactcagtttaaggtttagagtacgcatgagatttcttttcattctcctgcttcgcactcagactttattcgtatctatgggcctgcacttcaccgggggtctttctcatctctccagccttgcttcttgtcattctcatgaacaattgatcgacacctgtggaaaatagatggcaagtgggtgggatcccctgtgtctagagttctcagtgattctaaactatcatgcatcccccaactgggtcttttgacatttttttaaaagtgcagttattttcttcttatcaactttcttctccttatcctactctgccaagaattatagccactattcatttcttctctcctataagagacctttgacttttatagtttttattcattggattcccttaggaactctgctctgatgaaagctgaaaagctttgatagattacatggctcgttgttgctacaatgggatagaattcccttgcaatttcctacatcctacgagaagaggaagtaatgagctaccatacgcacataccatacatgtatgtattgtaccatacatacataagctacaaatcttatgattgatttatactaaatttgacaattcccctagataaagttgctagtagttggcagctcatcactgctcttgcatttcttagtctctgattcccctcttgcctttatacattacctttgtttttgaagtagtgattcttctttcatttatttttcttgttttcttaactgtttagccaaaattatccaaattattcttaaaaaattagagtagcacataatttcttaggagctatacaaatctacaaatttctttactatagctgcttagtagaaaaatagtgagttttaacaacttagatgtaaattaatatgtttgtgtttttttgtctcgttcattggtttaagaaaaaacacaggatactttttcctaatataacttgatatattataggacagtctcattggctggcaagcttctatagctgccaagaggcatgtatgtttaattttaatactgtgcatcttcggtctctaactcttatttcggctctcattcttcagcgtagggtgtaactgcaaatgacagtggcaccctgatttaactaatgggtgaaggctgagaagaatgtggataagtgagccatttgggcagtgaggagagcagtaaaccacacttttctcattagttgtctcccaggctaaaattaaacagaataaaatactgccaaattttagtgatctatggtggatgtggtctgtgtcaactcaatatcaaactaattacccagatatttatatgttagaacttgtgtgctatttttaaaggttggtatcttgtgaattgagtatatgatgaaaatctctctctaaattaaagagaacattatctctaaattgtaatttcaaccaaattgatgttaaatcaatgaattaccctcttttatcatctataacattcgtaaattttaaggctggctgtaagtcatgaggtcgtttttggtataatgtaatcatataacttacataggttggtgaagtatttttaactttttaattataataaaataagaccttcaagtttaattttccatttgaaaatatttattatatttgttttccgttttctctctctaaaatctcaaataaaatggtgtaccaatcacatgttgagaatttgtttgaaaattcattgaacacatttagttttagacatatctgaaaagacttctgtaacaatttgtacaatatggaggttatctgtaatttcttaacatacttgcatcttgtccagtttgcatacatttaaatttatatgccattttgtttactaggttttgaaattttttcatcataattaaaaaatatatagtatataatatggcctgtacttagatgcataatctaaaagaacataatcctgagttatttaaaaaatcaactcaatatcttttttctttctttactgttttttcaatgtaacattaggtatgtataaaaataggtaacatatatgtaagtattgaattaaaattatataatgaatatcatttactgttggctgagaagttggtcataaatttatttgcttttatagattctttccttaggtgatctgtctttttgagtacttttctgatcttctctttatcttcacttgtttacagcttctttttttgcttagtgtagatttattttaattatccagtttagggtttattgggcctcctagatttaaggtttactatctttcaacatttctgtaaaatactcagccattaccttttttaaaaaccatattgtctcttccccattctctattatctctctcgagcccaataagacatatgctatgtcttctcactcagacctctctatctctaacttcattttaaaagtttcattatttttcaatctgggcttacatcctaaactatcttgttatgtatcttccatttccttaattctctcttcaactgcatctaatgtgctttttaacatgtttagtgagttttgtacttcaacaatttgtcatttctgtgattttcatttttctttaaaatctacttgttgctgatgctttctcatagtttatcttcatgatttcataagtgtgtttttaaacattttatacattatcaggggaaccagcccctgataattcaacgtaggttcttttctattttccctaagtgttggctggtcttagaaataaagagaaaggctacaaaagagagaaatattaaagctgggtgtctgggggagacatcacatgttggcaggttctgtgatgccccctgagctgtaaaaccagcaagtctttattagcaattttcaaaggggagggagtgtatgaatagggtgtgggtcacagagatcacatggttcaagggcaacaaaagatcacaaggcagaaggtcagggtgagatcacaaggtcagggtgaaactagaattactaatgaaattccgtgtcccgctgtgcactcattgtcattgataaacatcttaacagggttcaagaggagagaaccagtctgactagaattcgccaggctggaatttcctaatcctagcaagcctgggggcgctgcaggaggccaggacgtgtttcatcccttacctgcaactgcataaggcggacacccccagagcggccattttagagccccccccccccggaatgcattcttttcccaaggctgttaattattaatattccttactggggaaataattcagtgatattcctcttacccgttttcagtaataagagaaatatggctctgtcctgcccggcccacaggcagccagactttaaggctatctctcttgttccctgaaaatcgctgttttcctgttcttaaggtgcccagatttcatattgttcaaacacacatgctttacaaacaatttgtgcagttaaagcaatcatcacagagtcctgaggcgacatacatcctcagcttatgaagatgatgggattaagagattaaagtaaagacaggcataggaaattgtaagtattgattggggaagtgataaatgtccatgaaatcttcacaatttatgttcagagattgcagtaaagacaggcataagaaattataaaagtattaatttggagaactaacaaatgtccatgaaatcttcacaatttatgttcttccatcagggtttcagcaggtccttccatttggggtccctgacttcccgcaacaatacatagctgttttatattctgtattctaataccttcagtgcttgaggatataaatgttttgttcattaatatttttgactcttattaacagtggtttattttctgcacttcttgctgatttttttgttatgggaaacataaatgacagatcataatttatgggtgtcacataacaatgaattggagactttctcaaagtgacaactttttttctgcttttttctcatgtctagagctaaggtcctcaacctctgggccgtggaccagttccattccatggcttgttatgaactgggccacacaaaaggaggtgagcagcaggcaagcaagcattaccacctgagctctgcctactgtcagatcattggcagcattagattctcaaaggaacgcaaaccctattatgaattgtgcatacaagggatctagattgtgcatgcttttatgagaattgaattaatgcctgatcatctgaggtggaatggtttcatcctgaaaccattcctccaccccccaaatccgtggaaaaattgtcttccacaaaaccagttcctggtgccataaagactggggattgttggtcttcacaagaaagtctaaggctcatctatctctctttcctggtgtcccaagtttcagaatcccagttacatttttttttggcggatgggcgggggggcaacagaacttattttttaatgtttccttttctagctgttactagtttcacaaattttcaggaattattttggtgtttatttctgtattttaaaataacatagcttttcttggtttttcctgaatattcattttggagcattatttattgacttcttactgtggaaaataataattggctatctttcactttctccaaccttcatcacatgttcttatttgctcatactcccaatattattatatcctaaatttgattgattacattgtttattcattatttcagaatttatatcattccatttattaacactattcacatctaactgaggatcacttttgtcttctgaatccaaagtcttctttcttcgtgtaattcacttttcttttagtgaatgctttctttattgtattttatgtggtatttatatgatattagttatagaacaaattacagttcaaggggctcatttgacagaaagaaattcatagtaatttaaatctaattttaattttatttatctacgtaggttttagaaagatcttttaacccttgagattgaattatatattcctgaatttaaataaaccttttaaattctctaaatcttgttcagttaattgctttaaaatcaaaaggtcttaataaacaatttttcatattgggggaaaattctctttcttacatagtaactttttcgggagaatgagttgttataaaataagaatacagtgcaaattaaatcttactgtatatatcgtactactttattcttgttagtctgtggagatgacagtctttgctgtagtagagctgccagaattgtttgaaaactggatatcatattgggaaagtcctatttatttctcttaatatagtatttttatacctttattctgtgtataagtgatacttgggaagtagaagaatttaggtccttatgagaaatttgcaatctatgaaagtaagaaatatatgttaaattgtatattatatattaaattggattttcagttgactttaattatgactcccattttgcaatcatcttgtgtttgcttagcttttctgtgtctttcttttctgacatctgcttgagtgaatcattgctcaacagtacacatattggtccttgggagggcacatgcttttgttgtctgagcatgctgcctaaggatttatactggttctgggcccatggaaaaaatagaactacatggtagaataggagtatacatggcaaattttggttatttgaagattctgtggaaagctttgaaaaaaagataaatttctttttctcttactttttctccttcatccttttatctgtctttttatatatcagtttcatagggcttgttattaatagtaattttcccaatttaaataatctataacattatagaacaaatgtactattttcagttatcctgagaaccagctatggtttattctgacatatactttttgtagccccctaccatcaggcagatactttttctttcttttttttttttttaaaaaaaaaagacttttattttaggttcagggatacaagtgcctgtttataatataggtaagcttgtgtcatggggatttattgtgcagattatattaccacccaggtactaaaaaataaaccaatggttatttttatctgatcctctcccttctcccacccttcaccctccaccctctgataggccccaatgtctgtttttctcctctatgtgtccatgtgttctcatcatttagctgccactaataagtgagaacatgtggtattttgttttctgttcctgcattagtttgctaaggataatggcctccagctttatccatgttcctgcaaaggacatgatcttgttcttttttatggctgcatagtattccattgtgtatatgtaacacatttccattatccagtctgccattgatgggcatttaggttgattccatgtctttgctattgtgaatagtgctgtggggaacatacgtttgcatgtgtctttacggtagaatcatttatatggttttgggtatataccttgtaatggggtggctgggttgaattgcagttctgtttttagctctttgaggaatcgccacactgttttccacaatggttgaactaatttacacttccaccaacagtgtataagtattgccttttcaccacaatctcgccaacatctgttattttttgacgttttaataatagctgttctatctggtgtgagatggcatctcattgtggttttgatttgcatttctctaatgatcaatgatgttgagttttttttcatatgcttgttggccatatgtatatcttcttttgaaaattgtctgttcatgtcctttgcccacttttcaatggacttgcttttttttttcttgtagatttctttatgttccttatagatgctggatattagatcttggtcagatgcagagtttgcaaaaattttctcccattctggcattttctcccatgccattcccattatggcattgtcatcatgaaatctttgcctgttcctgtgtccagaatgattatctacattgtcttctaggacttttatagttttgagtttttatttaagtctttgatccatcttgggttgatttttgtatatggtctaaggaagaggtccagtttcaattatttgcttatggttagccaattccagcaccatttattgcgtagggaatccttttccccattgcctgtttttttcaggtttgttgaagataagatagttgtaggtgtgtggtcttttttcttggctgtctattctgttccattggtttatgtgtctgcttttgtaaaggtgtcatgctgttttggttactatagtcttgtagtatagattgaaattgggtaatgtgatgcctccagctttgttcttttagcttaggattgccttgactactcaagctcttttttcatttcatatgaatttttaaatagttttttctagttctgtgaagagtgtcattggtagtttgataggaacagcattgaatctgtaaattgctttggacagaatggcccttttaatgatattgattcgtcctatccatgagcatggaatgtttttccatttgtttctgtcatctctttgagcatgttttatagttctcattgtagggatctttcacctccctggttaactgtcttcctaagaatttgattctttttttggcaaatgtgaatggattgcattcctgatttggctctcaacttgacagttgttagtgtataggaatgctaatgatttttgtatgttgaatttgtatcctaagacttcactgaagttccttatcagcttaaggagtttttaggccaaaactatggtattttctagatacatattttcatgttgtctgcaaagatagtttggctttctctcttcctatctggatagcctttatttctttctctttcctgattgctctggccaggatttccagtactgtgtctgatagcagtggtgagagagggcatcttgttttgtgccagttttcaaggggaatgcatcagcttttccccattcagtatgatggcatatttcctatatgctacgggtttggctgataacaaaattgacaaatatcccttcccttatgtttcatatatcctagtggagctaataatatttgtattaaaatatatgtacaattacagaaacttatttacagatgtatataacccgcacataaattgagaattgtatactctgctttaggtaagttctattcgaactacttttcatcagaaagggacaaaaataggttagttagttggttggaattgcagcctgttacacttccgctttgtgttttatgtcagaatgttggcctgcatttaatctaggctgccctttctctttgcttttgaacattaaaagttgtaatttttaatgattttttgaatgattataataccttctttcaaatcatgaatcaattttttaatataatgaaaaagttatttaggaatattttacctaaagtattccattttcagggccaatataaaaattgttctttgcctaaaaagttgagcttattattatattttatggacaaatgtacttttaatgagatgtaattcactttctatacaattattttatattgtgtgattcaatgttttatagtatattcaccaggttgtacaatcattttctaatttcagaatatttttatcactctcaaaccacatagctcttagcagttatttctactctcccctctcacaggccctggtaaccacaaatctactttttgtctctatgtttttgcctcttctggcaatttcatataagtggaattctaaaatatatgttttctttgtcaggcttatttcacttaatataatgttttcgagattcatcagtgctgtagcatgtatcagtacttcatttctttttatggataaatacttttccattgtttggaaataccacattttgtttattcatcaactcatggaaatttatattgatttcactttttggctgttacgaattatgctgatatgagcatttgaatacaagtttttgtgtgggcataagttttcggtgcccacatttcctcaaaaagacatatagttgcagtatgacccagttatgccatagtattttccaaagtgggtgtaccagtttacattcctaccagcaatgtatcagggtttgcattcctccacatcctttccaacgcttgttactgtttgtctgttatgtcatagctatcctacatggtgtaaagtgacaaatagcttattgttttttatgaggacttatgtaacagtttaaaaatcttgtcttttaggtgctgtacttctttgcagtatacaaggactagcagttaatattgacccaatcttatatacgtggctcatctatcagcctcagaaacgaacaagtagacatatgcaacaggtaagagatttttaaataattttttctgttaacaaatatttttcttattcatttagtagaattatatatgtcttttgatggattcttttttaacaaatgtactagatttcctttgtctccccaccttacccctttcaaacaattccgttcccttatttttgtatgagaaattgcatgtcagtataaagtttctttgattattaaaggggctttctgtacaatggcttacaaaacagaaactagtttaggagtcctatttcaccagtcttcattctttcatagtgtctacatgtccattctcatggtgtgcaatacataagaattgctcagtaaatgaatgttggcttgtttgttttgttttgagacacagtttcactctgcctcccaggctgaagtgcagtggcgtgatctcggcccactccctggttcaagtgattctctcgggactacctcccgagttcaagtgattcttgtgcctcatcctcccaagtagctgggattacaggcatgtgccaccatgcccagctaatttttgtatttttagtagagacagggtttcacctgttggccaggctggtcttgaactcctgacctcaagtgatgtacccacctcagcctcccaaaatgctgggattgcaggtatgagccacagcgtctgaccagcttttatttttatctctacatttccttgtcatatttaggttttttcaacaaacatgcatcgaatacctaatcctgggattgggatggttggtgcaaaaaaggttggaatatgtgtttgtttaaaaaggtataaattagaaagtagtaagtaggcaattatagtttctagaatacttaaacataattctgacagttttattattttcgttttaaagatgaagaaactgatgcttattgagattcatttatgtatagtcacacagctttaagtaaatgacagaactaagaatttttgaggccaaattcgtgctttattgaattataatttcccatcaacttaagtataattttgcaatatcctatttggaatagttttgtatcgtttttctgaagtaacttcaagctagttgatgggagaagaatacacaattttataattatgtaagaattaaaaagtttaacaaaaaagtactaaggagcaccttttaaaggtttttcttcactttgtcctaattttatttgaaacttctgccatacctgtccccatttttccttttaatgagtagttacagaatataaggcagtatgctgtacaccatggccacagaaataaaagtcataggtgagaatatccctccctctgagagtatttagtgtatttgagaatcttaagggatatagtaatgccatttttagtaattaactatgtagatgtatgtccaggattatgtgaaaacaagaggaatagttctcacaaccagggtagtgtgtgaaaaggaggaattaacaactaagctgagtattctaggagtgagacagacagagaaggttgttttagactgaactgtttgagcaaaggcaaagaagatgcaaaagcatgacaagaaagagacttcagtgattccagaatggagtcaagtgtgttcttgtagagactaggagaaattggaaaccaatttctgaaaaaaaattttgaatttgtagtcctaggtatttgagacttcattttgaagggtaaagaggagctataggaaattggtataaacagagctggattttagaaagtttactctagcagaatatagagaatgggtgatacagaagttagactaatggcagtaaccagttgggaataattttcattgtaaattcttgattggttattctctaagtaatacagttatttccagtgtaccatagatatccctgaaggtcaagtagagtgttctagcagcttaagtaaattagacattcatttaattgataccaagcatattaaaatattttgatttttaactttttaaaaaattataacttttaaaatgaacatacaatcacgtgccccttaatgatggggatacattctgagaaatgcatcattaggcaattttgttgttgtgcaaacatcatagagtgtacttatacaaacctagatggtatgacctgctagacatctgggctataatccatctctggtatagcctattgctcctagggtacaaacctgtacagagtattactgtactgaataccttaggcaattgtaacacaaaggtaagtatttgtatatctaaacatagaaaaggtatagtaaaaatatgccattataatcttatggaaccaccatcgtgtatgcaatccattgttgactgaaacattgttatgtggcacataattataggtatatttttcgaattcagaaataatggctttatttagaagctaaactacttgcaataccaatactttgggaggcaaggtgggagaattgcttgagcccaggagttcaagaccagcctggggaacatagcgagactctgtctttacagaaaataaaaattagctctgcgtggtggtgcaggcctatagtcccagctacactggaggctaaagcaggaggattgtttgtgcctgggaggtggaggctgcagtgaacaatgatcacaccactgtactccagcctgggcaaaagggcgagaccccatctctaaaaataataagaataaaaggtaaactaacaaataccataaccccactcattcagagttacaaataatgttggagtatatgtctccatacctaaatctttgcattcatctttattgacttggaatatatttttacaagtgtaattagtagcactaggcaagtattttgcattttagaaacatattttaagacttttgttgtatcaccaaattgcttccaaaatgggtataaaatttgcattttctttttcctttttcttttttttccacacaggttcttgctctgttgcccaggctgaagtgcagtgctgtgatcacaggtcactgcagccttaacttcgtgggctcaagtgatcctcttttctaagcctcctgagtagcagggaccacaggcacccaccaccatgcctggctaattaaaaaacaattttttttgtagaggtggtgtctcactatattgccccggctcgtctaaaactcctaggttcaagtcatctacccacctaagcctcccaaagtgctgagattacaggcatgaaccccatgtccagcccagtttacattttgaacagcagttgatagcattgttattttactacagtttggcatacttaaaaatatactttaaaaaatgttcttaatctactattttactcttgaatgttccccctgccccaccccaccatggaaaatcgagagaattgcatagttgagccatatgtttccatacccaggttcaatatttattaagtcatgaccactcatccttttaaaatctgttaggtgaaaaaaaaatgccgatatacaagtattggtgaaaatgtagagaatgattactattgttgtgagtgaaaatttgataaatttgtcagtatctaataaaattgaaaattagccaacttataaccccaaacttttacttcttgatgtaggtatgctcttagagtgaaattcataaaagtaaggaatactgtgtaagcctgctgttgtgtaatcattacaataatgtgaaaatttgaaaacctaaatgaaaatttgtaagaaggttgataaagtatgaaatattcacaggatataacatttattaaaaattatacaatagaccttagtatggatgtctcaaaaattgtagttgatgcaaaagcaatttcccaatgatgtatgcaatatgagggcacttatatatatttttctaaaactgcccttaatgtgtgtctgtaagtgaatgcaggtgtaaaaattaagttgaagcatttgtactaatatcataataatggttgactctgggaggaaagggcagtaggttggcactcaaaggggattttagttttatctataatatttttttaaaaaagcaaatatgataaactgttaatagccattaattattggtcataataggtatgttgtattctttgtaaccctctagtatttttttaatttgttaaattaataattagtgaaagatggttacgttttataggatgcagctatgaaaagctttaggtattttgggattatgggacatttttgggttaaagatagaacagatctgagactagattgcaactgaaatttgagaagagctacagtaccagaaggaaaaagaatatacacagggtaataggaggttgttaaaaataaatactacttattttgatgtttttgaccaaggtagccatatttctagaatagtggaggaaatcactggtcttactccttatttggtatcacttaatgcctgacatgcagcatctttattagcagtcattcaacaaatataggtattttgtatacagctgtgtacaaggcatacaagagccttactcttgtgttagaaagtggttttgtttggccttggccttttaattcttgcctgtgtgaaaatacactcagagttgactgggcacagtggctcacgcctataatcccagcactttgggaagctgaggcaggtggatcatgaggtcaggagttaaagatcagcctggctaagatggtgaaaccctatctctaataaaaatacaaacgttagctgggcgcagtggcaggtgcctgtaatcccagctactagggaggctgaggcaggagaatcgcttgaacccggagggcagatgttgcagtgaaccaagattgcaccactgcactccagcctgggtgacagagcgagactctgtctcaaaaagaaaaaaaaaagatacactcagagctttagctgcccaaaggtattttttgtttgttgtttagtattgtcagtaccacgaaaatttattggatctataaaattttatatggatttataaaactttgtgctttcattagttgcatctttcagctattgtgcttgaatttacactgtatagcacataaattttctctagttacttattatatagttgaccctagaaacaatgcaagggctagggacaccaactccctgcttggtcaaaaacccgtgtataccttttgagtccccctaaacttagctaatagcctactgttgatcagagaccttaatgataacataaatagttaattaacacatattttatatatgtgctatatatgttattcttacattaaagtagataaaagaaaatgttattaagaaaaccataaggaagacaaaatactatataggacgaaagtagatcattcttgaaggtcttcatgttgaatagtagactgaggaggaggaagaggaggggttcgtcttgtctcagaagtggcagaggtggaagaaaatccacatgtaagtgaacttatgtggttcaaacttatattattcaagggccaagtgtatattaattttaatcctgaacttggttgtacctttttagagtttggattgtattccaggaatataaatggacaaaaattcaaaggattatggagtcactaaatattagagtataagaggttttctagtccaccccccctccttatgttttagatgaggaaatttaaatgcatcaaaacttaacaatataaggagcatatctcatctaggtcttaaaaatggtttccaatttagatttgtgtattatcagtttgactaaataccaaatataaaagcaggcactctatgttatgatgctttcgataatttatttaatcttttctcattttaaatttttttttttttttgagatggagtctcactctgttgcccaggctgtagtgcagtggcatgatctcggctcactgcaagctctgcctcctgggttcaagccattctcctgcctcagcctcccgagtagctgggactacaggcacccgccaccatgcctggctgattttttgtttttgtatttttagtagagacggggtttcaccatgttagccaggatggtctcgatctcctgaccttgtgatccgtccgcctcagcctcccaagtgctgggattacaggcgtgagccaccgcacccagcctctaatttcttttccttttttttactcagtgtgactagcaacttgtaaaataatatgcccttttccatgtttcagaacatgattgattttattacatagttatataataaacatgttttcattgaaatacttttttataatgtacattatattgagtattttaagttgggtgaggcttaaggttggatctataaaactttggttgtggtactgaagataaccttagactacactgcagcctgaccaaccgccaccagattcaccatctgatacagctgtgttacagttatcatctgttgtttccaaagctaaaatttccttctcaaactgtggctaaaacgcaacgtttgatgattgttttccacccacttcagcatttatctttgatcctatggcaaacttaaaactttttttgccaataatatgacaaaattgtattgggcatcatcatcagtaacatcagactttatttcagtgaataaagatgaaacagctgctttattgtccagctcagccctcatgcattcaatagaggatcataatattttccagctttctctaactagttatttttctgtgctttctgaatatgctatggatatcttttgtcagacaaaacgtagagattttcagtattcttcaaaaaagttggactatccatattaacatgtacataatcagtttgtaaaagtatgtttctaaaaacataaggattttttttataaggatccattttataaggataactttataaggatacttttccattttttgaaaacataattttcaaagtgaattttaattttaacttgctctttccatattattttaatacttcttactaaaacttacattttctgggtacttacaggctctttggttttcactcagaattttaatttaaaatttaagtggataagcattgctctgtgtgtgcatgtgtgtctgtgtctgtgtgtgtgtgagagagagagaaaaaaaaaagcggggctgtggggacagatgagggagggagagattgattgatttacaataatgaagtctcagccccaacttgtgaaggactgtcctcagtattgccatgtttaacctttgctgcttaagaaatagtgaaaaactaaaaactaaaaaggttttcattttgtctctttccagcagcctgtggtagctgttcctcttgttatgccagtttgtagaaggaaagaggatgaggtgtctattggaagtgcccccttggcaaagcagcaatcatatcaggcctctgaatatgccagcagccctgtaaaaacaaaaacggtaacaggtatgtgtcaagtactgtaaagggactatgattgtactctacttctaagctagcaagttagcatccacaatttcatggatgctggccaaagacatgagactcattgagtggagacaaagaactttattatccacaacattagcaataatcacagtattagcatttttttgtgttagtgccctgagcccagtttccataaggtggcatgaagagggccaagaattctgaatttagggaacttgaaccttttataatggatagaaagcatgcctgccctattctccagagggaggcgctgtgtctcctttgcaagggtgtgagcccacttgccctttgcacagaagcaggatcgtatttctatcttctgagactgttcgctatgcaaatatccttaaaaacacagtagggaacaatgacaatcaccacctctacttaaaagacccatagagaattatctctcaatagtatgttccttctttaagtgaattcttgaaaacgacagtacaccttaatcatctttcctcccctttctctcatactctctgctagatcttctatgtaaatataaagtataactatccttctataaaataatttatttccttttgtgtaataaaaagaattttacatatataattcatcaatatataattaaaaaaataatttttatgattttattttgtgatttgttttttcttcttaacctctaatttttatgatgattggctacttttctttgggtaattttatgtcttttctttagctttatttcttataacgcagatattcccaaccacattgataaagattttatagtttcagtaaatcagaaccatctatcaagtctgttatgggcaagactctgttctaagtgaaattgagggcagaaatattaagaagatccctacccttaaagaatttaaaatataatcatatatgcaaggaaattcaaattagctattgtagtatttaagtcgtatttaacaaccaaaatgctaaaataaatttgtttatggtattttatacataagtattattattttgtgctttatgatttttcctaaaatatgacattaattatgtttattttgtggaatcattagtcttccacctgtccatagccacaagccttttactttgttgagattttatcaattgacaaaaatgcctgtgcctcattttgtatcacaaaaagattatatagtttgtgttgagttttgattataaaattaaatattctttcctttaaatgtcatgttaagtttaagagttagagtttaggttttacataaaggtttataattgagctgttaatttacataaaggtttataaacatcaccttttagttaagaaaataaatgtccattagtgaaaaaaaaatggtaagaattaccttacatgcatgtaaaccatatatttaaaataatggttaaggataattaacggtgacagaaaatgcttataatgtaaatgaaaatagatgatatagaactatttagaatatgcaatcacagattttgaaatgcatctgtatatgcgtggaaaagtttatatgtaaactcataccaatcacatatcaattcataaatgatatcagttgatctgataattattttgccttctttattatactttatgtttttataagaaattaataattgttagtgagggaaaataagctgaaaacataatttctcatcattaattactttataaaatatgaaaacataaacaacacattttttaaattttaaattattaatctgaactatggttcttttctttagaattaaggataattgcattttatgtctttggtgttcccccacctttagaaccatcagatatcctatagatattcttcttatagataaggacattattatttcaccaaatgtatattcttactcaagcttgcataaaaattaataggcatccaactaatgcttgtgattgccctgtttggtgactgtgagcagtcaccaaaggtaaaaggccttgagtataacatttattgtttatgaattctatttctttccctttgggtgcccactatttttaattctctggggaacttggcagtggtactcttcttgataatactctgtcctaaacattttctttacctagaattatgttttaacactttgttttatttttaattaaaggatacagtcttcttttttagaataaaaatatattttatgatttcttagagtgagtacatacatctaaatgtagttatcaatcactgttttaattattatttatattgcatcataaattataatgagtttgttaaggtattcatagtcttttgcacatctgcctaccttttttggttgttggtttttgtttgttttttaaccatcttagccattttcagtagcattaggtataaatcagtagcattaggtataatcacattgttgtaaaatacacattttattttttaactacatgttacagtggagaaatgttaatgttcattttatttctgagttcttattaaaattattttttaaatttatatcatcacagcctatggtccaatgttgattttaagttcatccccaacaagttatatatagtggttttgacacatgaatacaaagacctgctgatactgcactgggtttgattttgctttttaattattcagttagaagcagaccttttcctcttccaaactcagccaatgttaagtggctggctacagggggacctgtgcttgatggctcggaatgtgttaacagcagaatgccactatttcaatgatatagtcatgtagggcagactgagccagaataaaaacttgctgttccacatgaagataatctattatcacagaattctaaataatcttccagagaatctgtatatccttcaaaacaatgaaacccctaagagctatgccatttgtttaccctaggttttgaaatgttataaaccttaatttggaattcttgatgaaaatgtctgtgatggagatgaaaacttaacaagcagaatactccataaatgatacttaagagatataaaccattttatcttacaagtttatatattacttctcacgtcaacataataaatacagttaaaataatagaagccttttaaatttaagacaccttgactattgctaagatagtaataaatgaagacatgtgataatgatgtagatttggtagataatactataaattcaaaatatagaactttagcttctggccatgatagagtaacagggtttagatttatattcctgctgtaaacaactaacaaactggataaaatatatggggaaaattccccagtttctggacattggacaataggcagtgcaggagtgtgattcctcatagaaaggaaacaaaggtgagtcctaggatttccctagctttctgcctcaaggcaagtttctgaatacagggcagaataggacatctcaaactgagctcagcagtctttctgagttgtagagacaggaactgaagttaagggaggcagagatgactagaaattatggaataaaattccagagatgaagaaagctatgcagagaaagagcccctgggagcaacaatagagttcttgagagtttgctgaatagcaagacatgaatgcatggcgatgagacctcacagggtttggcaaggaataacctcggagctacgatcttaatgattcccatccttacacagggtggaaggcattgaagttcctactgtccatcatatataattctcattggttatttaggacattcagtggagaccagaaggtctaggcctcagtagtggggctaaactatctatagagtaaaggctaccctagactcaccttaaacaagcttgtaaatcagcctctgaaggaaacaaaatagtgagtaactgttactgttaaaaggaatacaatactattgtagcccaacatcattaaaaggaatacaataagatggagacatacaacaacttaaatataacagttgcaaacattcaataaaaaattactagaggtgcaaaggagtgagaactacaaacaggagagaaactagccaatagaaataggctgagaaatgacaccaatgatagaattagcaggtatattaaatacctatatgttaaaacaggtgtcataactacgttgaggtatttacaagaagttggacacattgaggagagaaattgaaaatatataaagagccaaactcaattctacagatgaaaaataaaatatctgaaataaaaaaatttagtggaattagatgttgagtagtagatattgcaagaaaaagaaattaattaacttgaagacatagtgatggaaacatgccaaaatgaagcacaaagagaataaaggaaaataaatgtacagagccttatcgaaccgtgggatgataattaattatggttgtgagggtagggctcactgaaagttcacatttgaccagatacttgaagcaggagagggagtgagccatgtagacatctgtggataaatgatttggaattatctatgtatctgtatctatatgtatacatatatatatatttagaaataaatgatacactgtaaccctttcattttataattaagactattgagtcacaaagaggtcaagcaacttatccaaagttaaaaagatatttattgagactttttaaaaattgaaattgccagactataggaagagatcaagcaacttatccgaggttaaaaagatatttaatgagactttttaaaaattgaaactgccagagtataggcactttgcgattatttccttcttccactctgaatatttcctgctttctttctttcatggcattggcagtcctgcaaatcaggtctgtgcaaattttgtcatctactatttcatctctaatacctaatatatagccagccaacttcagtgtgtttttttttgctaaggaattactctaaatttgcagccctgtcccgtggcactaagatagtgaaagattttgcatcagagttaccaagatagatactactgggaagcaccttttatgatcgtgtttcataatggcattgatggttccacctttctttatttgagtgccacttcactgatgcacagttaagttcctggatgagactcaaaagtgaaacactactgttggtatatattttttggccttgatatatccttaaatatattccagaatactaaggcttctaccaaaatgaaaaaaaaaatgatccttcagatgtttccatttttatcaggcatatggaaaatctatcttttatgcctaggtctccaagagaagtaaatatgaaaaatcttgaaatcttaaaaagtacattgtttatattacagataataaaaggctttagattattgttacttgtttttaaagaatctgtctttggagaatcatctttggttattgagtagaatatttcttctttatttatttatttattttttgagacggagtctcactctgtcgcccaggctggagtgcagtgacgtgatcttggctcactgcaacctccacctcctgagttcaaaagattctcctgcctcagcctcttgagtagctgggactacaggcacgtgccacatgcccagctaatttttgtatttttagtagagacggggtttcaccgtgttggccaggatggtctcgatctcttgacctcgtgatctgcccgcctcggcgttccaaagtgctgggattacaggtgtgagccaccacatctggcctgagtagaatatttctaattacatttttttgctgacctcatttcaaggtgtaatattttaaatttatgccgaagtttaataatatattgtttaggcttaagtttggctgaaaatatcagactactctaaataacagtgctttaaacaagatccaattttgtctctcattagaaagtttaagcacgcaccctaaagctattatgatctttcaagatcaggaagctttttattctactttgagtggccttcattgccaggctttcctcatggttcatgatggtggcttcagcagttaatcaagtctgcatttcagtgagcataaatgagtacagtgaaagaaaaaggtgctttctgcctcattaagcactacccagaagttgtacaccccattttgtttatatactcttgactagaagctagttacatggtcctgtctaactgcataagaggtcttgcaaatgtagtatgtaatctttaaggccatgtacctggctacaacttgtatgttctaactaagaaagaaagggagagtggatagtagagattatttagctgcttccaccatagtaacttaaaatggaaaatcaaaagctgaattttggaaaaaaatagagaataaaaatattttccttttagtatgcacatcacaagacaaagctggttaaaaaaatgtttttagtgttgcttagatatttcacagtaagagatatagacttgggagtcatcaacatatggatcatagtggaagccacagagtggttgagatttctcaggagaccatacagagcaggatgagaagagagtgcaaaattacattcaaaggaactctttaatggtagagtaaggagaaggagccaatggagggagttcagaagcatgattatgagaagtaggcaacaaagctacatgtatatgtgtgacacaattccaaagagttgcaagaagaaggtgcatgacatgctgtagaatcatcaagaacaatgaggctgaaaaataggctgttagtctgtggtcagttggccagaggacctttagttgttaaggaatggatgtgaattgaagaaggagggacaacctatgtacaccaatcattcaagaaatttgattatatagtcacttggggtatgtgtatagcaatagagatgtaaagagacaaggagacaaaattggagataccacaaaggctgaggataatttatacagtgagatcataggtaagcaagatataaaacccatgcacagatgtgagacttaacgatcaggaaaaatcatttcttctttaagacagaggtaagaagataagactatgtatcattatatattcatttagttatttttctttccacaaacaagtatttaggtgggacaagtattttttttttttttgcactgttttagagaatctaagagatcaaaaaatgtataattttctcatgacaagcctcctatttttctcatacagggaaccagtttttcaggttaactttggaatgccctggctgagaagaggggttcattcagatggttagcgggccctaaaattttattttttctttacaaatgtcatttgaaaatattaaagcatgaaggtagacactattatataatatgcaatttattttatcagggataaaagatggttttaaaaaattttactactttggaacagaaaaaggttgaaaataaaataaagtctatctaatgaagtacatctaaagtaaaataacttgaaaatgtaattcagaaagtcgtcagagaatttaatgaaaatatatgtttactaagttgttttgtacattgtaagaaaaattatttttatttctaaatcaaaattcaagggaaaaaagtattagtctgcagagcttaaaatgatatacaaagttaaaattatttcataatttgtttctgcactattctaggtaatcagcataatttataattagacaatatttctaagattaattttctaaaggacttcaacagatgctagatgattatttgatatgttacccatattgtagatgattgtagccgtagacttcatttccttaactctgtttttttaatgtttcatgttttatgaaggtaatagtttatgaagatgataaatatgaattatctctgatgatagctatcactttcataaacatgaagcatccttcggtcatctcatgacaatcttttatagccgtatctatcaaatgcattacttagttgacatttaccacatatttgaatttcttgcattgctagtgttcatatgaaaactcctgaagtgaatcattagctcataaagagatgtaattacactttatttagtatgtctccatgtgtgccgtgcggagtattttatcattggtatttgatgattaattctaacaaagtgttcagtttgttaagcagactgggtttatctatttttatttttaaatatactacactttatttaacatacatataatgtcctatcttgttggatcgttttcttgagagagtagcaattattccatatttaatttttaaaaaattcttggtccttacatctttggctcactttttatttttctaggattgtaaagcagatttatttgtgtatggtttcttctaatgtgttcaagttttgctttctatttttactttgaaggtagagcatagacttcattaaattttctcagaagagaaagctttagaaggtaaattatgttgaaaaattgcttctacttctgtaccctattggagttatttgacttccattactgttagcactacctcactcccgtcccacttttgaacatgctggcccaaacttggaacaaaacaacaaaaagagggagggggaaataagaacccccatccccaccccaaaacatggtttcttggtttccttcagcacagctgaggcaggctaacattttgttaaaagcgttactgaatactaagaaggaataaattagaacaaatacagaaaacataaactatttaaaaatagttaaccctaaaatagtagtcttcaattgtttttcttagtgcacgcctaccagtaattttttgagcaagcatccatagtagttattgatttatacattaactatatgtatcactatttaatgtaataaagcgtgtaaggttattttaattttattattatttaagttgtactattcagatggaattttaatacatcagtaatgtttcagtgggtataatattgcatggtattacttttttttgtttttgtttttgttttgtggcggagtctcgctctgtcatccaggctggagtgcagtgcgcaatctcagctcactacaacctccacatcccgagttcaagcaatcctcctgcctcagcctcccaagtagctgggattacaggtgcccaccaccacacgtggctactttttgtgttttttagtagagacagggtttcaccatgttggccaggctggtctcgaactcctgacctcaagtgatccgtccatctcggcctcccaaagtgcttgtattacaggcgttagccattgtacccagcctgtatggtattactttttaaatatttgtttaatactttgttataacaacttataagtttaatttttaattaagtttattccaattgttggttttaatggctgacataattggaaagctgcctcactgagatacatcatattgaagagatgaaaagggcatcattgactgtactcaggatacttatttttcagtcccatctattttgcaaaggtttgctgacataaggctagtaaattttcatcttccttgtaaaatgagttatttcaatttaatgggatagtattgccttttttattcaaataaattagttttgtctttaatccatatttttgagtgtgttttacaggaatatttttaaagtgtgtatacaggttatgagtattaatttagttaaaataataaaatttttaaacctgattaactgtacatggtaaattgtaatatgccacaattaactgaaaacaaatgaaggattgaagagcccttggcaattctttcttgttgttgagtgttcctgttcctttgtatacttaacatagtgttatctgtggccttctgacatgaggaaggactccaatgatagtctactgtattaaatattaataaactatggctgggcacagtggctcacacctgtaatcccagcactttgggaggccaaggtgggcggatcacctgaggtcaagagtttgagaccagcctggccaacatggtgaaaccctgtctctactaaaagcacaaaaattaactgggtgtggtgacgcgtgcctgcagtcccagctactcgggaggctgaggcaggagaattgcttgaacctgggaggtggaggttgcagtgagccgagatcgcgccactgcacccaacctgggctacagagcgagactccatctctaaatacataaataaataaataaatgtgtttctcatttttagatgaaagttagtataagtggatattctcatgttggccaggctagtctcaaactcctggactcaggccaggaacaccctatgggtgttcttgtagctttgtgcaccacatattttggagaatactgttgtgttggaatgttattatctgaaagtttagcattacctagagaaaacctctcatgtaaagttcagatatgattatcctgtggtgcagattcactgtgcagtggttaccaacttgtccagtgagacagaacacactcacatgcagtgagttacatgaagcagatttatgactatgctcacaggcatcaagggacaatagaagcctaggattcagtgtgatttgtccccttcatgtcccccagactccagaaaggtgctcaggttaaatggtgtctcatctgtgtatgccgcacttgcactacacctgagggtccctggaagacatctctctctgggttttatattccatggtgatatgacttgctggctaaagcattacagtgtactgtttctggtcgggactggaacagaacttgagctgttttggtcagtcccttcctatcttaagatgttgtgttgtacaattattcttaagaactacaagtgaaaaaaggaggagaactgggtggtccaaggccaccagagcactgtcctgcagatcccaaggagccaatttaaactaagaaaggtattggctgagatagtgaaagaagtctttcctccttctgatcagaggagtaaaaagaaaaaaaaaaatcaatagcatcttcaaatctgctggcttaggcagataatcagtgggataatgaccagtgaatatactaatagaaggactgagagtcaggtgagctaggaaggcaatgaagttgaacagctcttgaagaagtaagcctgagaaaggagggaaataagtctcatgatatgcttaaagcattgtgggatctatgcagtctatgcaatgatgttgctagggcagggcacatacaactactaaccaattgcctggtattccccaaattgataggtgatttctttactagcgaataaacattcctaaattaaattagaaaggactcttcaattgcaagagacaggaactatattcaaatgattttcagtttgaaaaccagttgtggcagactacttattgaatcccataaccaaaacggtaaaggcaaagatggatcttttcttcggaatgacttagaaccagagattccacattatcaggatgccatcttttcatgttggtttaaccttctcttactgaacacagatttcttgacagttttgtacatggctggggtacctctgaactcacatacttaattctctatgatcaaagaaaaacaggtcttatccagtgcctattgaaaatgtaattgaagcactttaagaggtcgaggtgggcagatcacctgaggccaggagttcaagaccagcctggccaacatggtgaaaccccgtctctactaaaaatacaaaaattagccaggtgttgtggcacatgcctgtagtcccagctaatcaggaagctgaggcaggagaatcgctcgaacccgggtggcagaggttgtagtgagccgagattgcgtcactgcactccaacctgggtgacagagcaagactctgtctcaaaaaaaaaaaaaaaaaaatgtaattgaagaggattttgcttgactgtcttaaatcatgtgccgacctcttggacagtcactatggtcaggaaggttaggtactatgattggcccagtggcagcccaggttgggtcatgtattcacccctgtgttctggggcatgagatataatgccagaaaaaatgcaagaatagtagaaacatggctcatgaggttaactccagctattccagtttgtacgtactaattttttattttacaattagtcacagcaggtttaaaacacattactgttttgataggaagatggtaaattgattatgaaggtattagtcacatgaactagggaacgggggaaaaatctggaaggaaaagacatgagatgcataagacagattgcagactttacaacaggctttgttttagtttttttaaacacagggtttattcaactgagggaaaggaattacgatatgtttttgttgtgtgcagttttgaacaatacagttttgcttagcacaatgtattaatttttcaacttcatctgtttcattacaaaggttttttcccaaggagccattaatttgaattatcataatatgtgatttgaactgtaatgtcacttaattttaaagttctttgagaacacattgcaatgttaatatgtgaacgtttttcaaatatagagttctttggaaataagtgtaagttattctagtttttacacagactggcaagaattcagcaaaaattcaaccaatttttttttacagtcttttcacccccttttagtagtcagaacaagattatagtttccagatgaaattctgaatgtcacatagtgatgacatacattttcctggttggctcagcatgagatgcaattttgtatgccatgtcacgctgacttgcagaatccaaaagctgttatttcccaaggggctttcaagagtgatagtattaaatgcaggtttattttgatgaaaagtctcatgcattattgcagttctgtggcaagtttcttaaagctttgaatattgtctaacttgtagaaattttaaaaatagtactacataaaggtcactttctcttcaagttatttaaatttatattgccaaatacagttgccaaaaataatgatgagtgtaaaatataaatcaagaattaggaaggtatagtatataaaccagtagcttagggaccaaaacacctaagtttttatcttaccctaccccatgttaagctaacatcacacggtcttgtcttcttcatttataaaatgatgataagtttacccagcaatacctcaagtaaagtaagatatgtgaaagttctttaaaatgataaaacacaattcagaaggtgaagatcatatttttgatgtttgaattttaaagggaaagctgtagacttcaagcatggtgaagcttattttgactaataagtttctagccttgtggtaaaattttattctttcttttttcctttggatcttaatcatctacaagttgccttaaatctcagtgtatcagtacagatgcctacataatgaaatttatttcacactgatgatctgccttcttttttagacttgtctaactgacctgctctgttataccagtcttatttttttttctcttttttaaaggtgcctcatatccaactgcctacacatctctacttaggtattatatggggtgctcaagcctaacatgtcttgtttcatctgccttcctaaatttatacaactgtgtacctttccccgaaccttcattcaccatgatgctcaaggctgagacctaggattcatccttagtgtctccctttcctgtccattccacttccaagttgtatcttgaatctttttgtctgttcgtatgccacaacaaatggagccacatcattttttgtacagagtaatgtaagtatatgctaactagtcttactggtgccatttggtattatattatcctctgatctcagttacctcaattcattgttcacatggcagcaagagtcatcttattaaaaacctaaattagatcatgtctctccctgcttaatcgcagtagttgcttcctattgcacttaagatataacccagacttcttaccatgctctacacagttgaatcttatctaacctccattaggttctcccatggcatctttgtcatttttccttacatggatcctgtttcattttcttatatacttcatccttttttttcttttttttttttccttgagatggagtcttgctctgtcgcccaggctggagtgtagtggcgtgatcttggctcactgcaacttcccacctcccagtttcaagcgattctcctgcctcagcctcctgagtagctgggactacaggcacccaccaccaacaccagttaatttttgtatttttagtagagatggtgtttcaccatattggccaggctggtatcgaactcctgaccttgtaatccacccaactcagcctcccaaagtgcttggattacaggcgtgagccaccatgcccagccgctatatacttttcatactgcaggtcttagtttagatgatcaataaaaaaacttctgtattccctaaaataggtctgtaccactcacccaggattctttaacacccctttctatccttagaacacttatcatgtatcctgttcttgttttttttttttttattctctccttctctagaatatatctcaagggctatatgtgaattgttcatttttgtattcccagagtctaatagccatttctggtattgagcaaatatgtattaaatacttgttgcatgaatgaattaacctttttgtttctcgttatttttattcagagatgtaaaactctcattccttaatcttttaaacccctgttctttaattgatttaagttgatgtcctataacttttcatatctgttctggtttctcacagatatttatcaaatattcagaaggagttagcagctcatggcacaatttcacttcgtgtgcataatcttccagtgtattcctgctacatcagaaatttagatatattttaaaatgttgaattattataagaatgatccaagtacaatgcaggatattaagataaaattttacctctagtcagtgttctccactctgtgctagtgggttggggaattgcaggtaatgtatgacatggcttctgttatgatgaactttaggttatatctggagagagaaaagtaacgtacaaatagtagactttagagaactgaggaaaattgagtggaaggaatcattactatagattttaggaattagaaaagttttcattgagaagaccttaggataggtgttagatagggtttgtaacaatcatgaaggtgctttcatttggatgggaacagcagagagaagacactgattggagtaaagagtctttagtggaaacagtggaaaataaagttgaacagagtttcagagaatcaagaccaacttatacagggctttgaaaaccatatagagaactttgactttctaccagagattcattcttaagtagtatcctatagctgagaattgtctgtaggatggaactaaaggaggaagacccttttcagaactgtgagtaaatctttatagtgatgaacattttcaacaaattggtagccagggaaacaaagaagaaagtacagatttaggttatttctgaaactaaaaattgactttttttcttaccctttaaaaaaggtatatgtaaatttatgtttatttcttttgagagagtcccaagtcatttttaggatcatgaatgataatagcttctttttcatagtcatacatatgtggtttagaataaagtgagaggtcatcagtgcttctacaattattgtacgttctacattatgatacaattttttgctatccatctatttctctccttataatgagagcccctcagagatgtgaccccagtctctttgtttctccatgacctagcacaagtaggcactcagttatacttattgaattgaactaagcgacttttccatagctcataagtcttggaagaggccagcattttcctttatctcattttcttttctttttttttgcctattaattaattagtttatttttttatttttttattatactttaagttctagggtacatgtgcacaacgtgcaggtttgttacatatgtatacatgtgccatgttggtgtgctgcacccattaacttatctcattttcaagtgttttccaagccacatcaacagaatgtaagaatgcaatgtaataagattcagaagttggcatctgtttgactttatttctgctgtgctgctgaaattttaaaaatctttttgtgatcttctaaagacatgaggaaatgggggattgagagaaaggtgatgaggatgagattcccttctgctatgttcttcaacctgtattcttgccaaaattcttctcttcatggactagcaaggaggacaatatggctggtgcagagagagcactgggaagagggatgtaagaggaagtaaaaaaagacaagaggaagccagatcctgtagggacttacaaatcattgtaacgactttgactaataaaagtgagcaagatgggatggcatttaagggttttgagtagaggcatgatataaccttttttggctattttaccaatattaatcttgatgctgtattgagaatgcactgtagggagaaaagtgtagaaggagataagccgggtgccatatggctcttggccatagtgtatatctataatcatggtaactttgccaggtagtattactagaggatgcaaggtcaaattcaggatctattttaagatagagccaacagattatagtaattttcaggatgtatggtgtaacagagaagggtcatggttttgtttgtttgttcgtttgtttttgcagccagaaaggtggattaggtatttattgaaacttggaggactataagatgaagagcataggggcttttgagaaagagactcaagagttttgctttggctatgttaaatttgaaattcctattaactatccaaatggagatgttcagtacgcagttggataaatagtctggagcttacaggatagatccagacaattccctggaaatagaatcctcatagaggatacttaaagccatgacattgagtgagatcctctaagaagaaagtgtttgtagagaagagaaatggcccaagtactgaacccttggacatgccagcattttgtggtctggagaatgaagaattaccaagaaaactgagaaagagctacaactgaggtagaatgggaacatggagatggtagtgttcagaaagaagtgaagactgtgttttaaggatgtggaaatgatcaactttttcagattcctctaatagttcagtgttaaacaatggctctaaaaaactaccacagaaattttagtgactcaacatagcagaattcatttctagttctaggaaagtccattactgagtccacagtatgatagctcttctccaagcagtgaatcagccaccttccatttagccactctgaggatccttagggcctcagattcagaaaagagttttaggaagataaagattttgctgatgacatatcatgagttctagatggcagaatggaggagattgcagtgtgtggagtgagagatgaggtcaggtggggattgcacaggtctgtttagtgatgagaatctgggtgatgaggggtattgttagaattttgggtttttcctgatggctgatgtaaacagaatacaaatggcataaaggaattagtactggggtttctaatgcagaattaggtggcaaggctgtgagtattggggctggagggatgtggtctttaatccctctgggattacaggcatgagccaccatgcccagcctgaaacaagtttgaagatatttaaatcatacattcagtaaatatgtacaattgtatacttagtggattttttaaatatttgcaattagatatgtcaaattaaattaccaaaaaataatcaaatttttaggcctggggtttttctttggattgcaaagacccccacaaaataaccaaggatcataactttctttttccgctctccacttacaggaaaaacaattaaatgcagatcaagtaaacatatttaatggatttatttaagttaacatccggactacatgctggcgtcataatagattcaacttacaattcttgtatcaggaatcaaataagatgagaagagttttgagtattagcaaaacaactcctagttggtctctattttcactctcttcctcttccaattatgtatcctttgtgttaatataagaattttcacttcataactcaggaatggaaaaccaaatactatatattctcacttataagtttgagctaagctatgggtatgcaaaggcatacagagtggtataatggacatgagactaaaaaggtgggatgggggaatacttgggtgacaggtgcactaaaatttcagatttcaccactctaccatttatctctgtaaccaaaaaccaactgtatctctaaagctattgaaaaatttaaaaatttgttaaaaataaaaagaactttcacttctaaaactcaaattttattacacttaattgtttaacagttttcactatctcttggtaccttcaggatgaacttcatgtttctttgcaagatatttaagaccctgcacaagtaggccttatcttgtctttctggccttacctctagtataccagttgcattttttgtgtggtatacttcactcacactaaactacttacaatgcactttgtgaatctgtgcctttgtgcatcttctttctgtctgctagtccttctgtctttgatttaagaattctttctcaaacaaactccatgttacctcctttgtggaatctttcctgccaatatttgagtgaattaattcaatcttgctgtgttaccagaattatttatttatttatttatttatttatttatttatttattattataatttaagttctgggatacatgtgtagaacatgaatgtttgttacataggtatacacgtgccatggtggtttgctgcacccatctacccgtcatctacattaggtatttctcaaaatgttatccctcccctagcctcccaccccacgatgggggccagtgtgtgatgttcccctcccagtgtccatgtgttcttgttgttcaactcccacttacaagtgagatcatgtggtgtttggttttctgttcttgtgttagtttgctgagaatgatggtttccagcttcatccatgtccctgcaaaggacataaactcatccttttttatggctgcatagtaatccatggtgtatatgtgccacattttcttaatccagtctatcattgatgggcgtttgggttggttccaagtctttgctgttgtgaatagtgttgcaataaacatacgtgtgcatgtgtctttatactagaatgatttataatcctttgggtatatacctggtagtgggattgctggatcaaatggtatttctggttctagatccttgaggaattgccacactgtcttccacaacggttgaactaatttgcactcccatcaatggtgtaaagtgttcctattctctgcatcctctccagcatctgttgtttcctgactttttaataatcgccattctaaccggcatgagatggtatctcattgtggttttgatttgcatttctctaatgaccagtgatgatgagcttttattcatatgattgtaggccgcataaatgtcttcttttgagaagtgtctgttcatatcctttgcccactttttgatggggttgtttgttttcttcttgtaaatttgtttaagttctttgtaaattctggatattagccctttgtcatatggatagattgcaaaaagtttctcccattctgcatattgcctgttcactccgatgatagtttcttttgctgtgcagaagctctttagtttatttagatcccatttgtcaattttggtttttgttgccgttgcttttggtgttttagttatgaagtctttgcccatgcctatgtcctgaatggtactgcctccgttttcttctagggtttttatggttttcgtcttacatttaaggttttaatccatcttgagttaatttttgtataaggtgtaaagaagggcccagtttcagttttctgcatatggctagccagttttcccaacactgtttattaaatggggaattctttctccattgcttttttttcaggtttgtcaaagatcagatggttgtagatgtgtggtgttatttctgctctgttccattggtctatatatcagttttggtaccagcaccatgctgtttggttactgtagccttgtaggatagtttgaattcaagtagtgtgatgcctccagctttgttctttttgcttaggattgtcttggctatgcgggctcttttgcagttccatatgaaatttaaagtagtttttttataattctttgaagaaagtcaatggtagcttgatggggatagcactgaatgtataaattactttgggcagttgaccatttttgtgatattgattcctcctatccatgagtatggaatgtttttccatttgtatggaatgtttttccatttgtatgtgtcctctcttatttcgttgagcagtggtttgtagttctccttgaagaggtccttcacatcccttgtaagttgtattcctaggtattttattctcttagtatcaattgtgaatgggaattcccgcatgatttggctctctgtttgtctgttattggtgtataggaatgcttgtgatttttgcacattgattttgtatcctgagactttgttgaagttgcttatcagcttaaggaggtttttggctaagctggtggggttttctaaatatacaatcatgtcatctgcaaacagagacaatttgacttcctgtcttcctacatgaataccctttatttctttctcatgcctgattgccctggccaaaacttccaatactatgtggaataggagtggtaagagtgggcatccttgtcttttgctggttttcaaagggaatgcttccagcttttgcccttccagtatgatattgactgtgggtttgtcataaatagctcttattattttgagatacattccatcaatacctagtttattgagagtttttagcatgaaggggtgttgaattttattgaagtcctttgctgcacctattgagataatcatgtggttttgtcattggttctgtttgtgtgttattgatttgcgtatgttgaaccagccttgcattccaggggtgaagccaacttgaccatggtgtataagctttttgatgtgctgctggatttggtttgccagtattttactgaggatttttgcattgatgttcatcagggatattggcctgaaattttctttttttgttgtgtctctgtaggttttgatatcaggaagatgctggcctcataaaatgagttaggaaggagtccctctttttatattgtttggaatagtttcagaaggaatagtaccagctcctctttgtacctctggtagaattcgtctttgaatccatagggtcctgggtttttttttgttggtaggctattaattactgcctcaatttcagaacttattattggtctattcagggattcaacttcttcctggtttactcttgggagggtgtatatgtccacaaatttgtccatttcttctagattttctagtttatttgcatagaggtgtttatagtattctctgatggtagtttgtatttctgtgggatcagtggtgatctcccctttatcattttttattgtgtctatttgtttcttctctcttagttatttcttgtcttctgctggcttctgaatttgtttgctgttgtttctctagttcttttaattgtgatgttaggatatttattttcgatcttttctgctttctcctgtgggcatttagtgctataaatttccctctaaacactgctttagctgtatccccgagattctggtacattgtgtcttagttctcattggtttcaaagaacttatttatttctgccttaattttattatttacccagtagtcattcaggagcaggttgttcagtttccatatagctgtgtggttgtgagtgactttcttaatcttgagttctaattttattgcactgtggtctgagagactgttatgatttccattcttttgcatttgctgaggagtgttttacacccagttatgtggccaattttagaataagtgtgatgtggtgctgaaaagaatgtatattctgttgatttggggtggagagttctgtcaatgtctattaggtctgcttggtccagagctgagttcaagtcctgaatatccttgttaattttctgtctcattgatctgtctaacattgacaatggggtgttaaagtgtcccactattattgtgtgggagtctaagtctctttgtatgtctctaagaactttgtatgaatctgggtgctcctgtattgggtgcatatatatttaggatagttagcttgatccctttatcattatgtaatgcccttctttgtctttttgatctttgttggtttaaagtctgttttatcagagactaggattgcaacccctgctttttttttttttttgctttccatttgcttggtagatcttcctccatccctttattttgagcttatgtgtgtctttggacatgagatgggtctcttgaatacagcacactgatgggtcttgactctgtatcccatttgccagtctatatcttttaattgtggcatttagcccatttacatttaaggttaatattgttatgtgtgaatttgatcctgtcatcatgatgctagctggttattttgcccattagttgatgcagtttcttcatagtgtcaatggtctttacaatttggtatgtttttgcagtggctggtactggtttttcctttttatgttttatgcttcgttcagaagctcttgtaagtcaggcccagtggtggcaaaatttctcagcatttcctttctgtaaaggattttatttctccttcgcttatgaagtttactttggctggatatgaaattttgggttgaaaattcttttctttgagaatgtcgaatattggcccccattctcttctggcttgtacggtttctgccaagagatccgatgttagtctgatgggtttccctttgtgggtaacccgaactttctctctggcttcccttaacattttttccttcatttcaaccatcattatgtgtcttgggtttgctcttctcaaggagtatctttgtgatgttctctgtatttcctgcatttgaatgttggcttgttttgctaggttgaagaagttctcctggataatatcctgaagactattttccaacttggttccattttccaggtcactttcaggtacaccaatcaaatgtatgtttggtcttttcacatagtcccatatttcttggaggctttattcattccttttcattcttttttctctaatcttgtcttcacactttatttcattaagttgatcttcaatctctgatatcctttcttctgcttgattgatttggctattgacacttgtgtatgcttctcaaagttctcgtgctgtgtttttcatctccatctccatcaggtcatttatgttcttctctaaactggatattctagttagcaattcctctaaccctttttcccggttcttagcttccttgcatttggttagaacatgctcctttagctcggaggagtttgttattacccaccttccgaagcctgcctctatcaatttgtcaaactcattctccatccagttttgtttccttgctgcaaggagttgtgatcctttggataagaggcattctggattttgtaatttacagcctttttaggctggtttttccatagtcttcatggatttatctacctttggtctttgatgttggtgacctttagatggggtttctgtgtcaatgtcctttttgttgatgttcatgctattcctttctgtttgatagttttccttataacagtcaggctgctctgctgcaggtctgctggagtttgctggaggttcactccagaacctgtttgcctgggtatcaccagcagaggctgcagaacagcaaagattgctgcctgttccttcctctggaagcttcatcccagaggggcacccaccagatgccagctggagctctcctgtatgtggtgtctgtcgacccttgctaggaggtgtctcccagtcaggaagcacgggggtcggggacccacttgaggaggcagtctgccccttagcagagctcacacactgttctgggagatccactgctctcttcagagctggcaggcaggaacatttaagcctgctgatgctgcgcccacagccgcaccttcctgcaggtgctctgtcctagggagatgggagttttatctataagcccctgactggggctgctgcctttctttcagagatgctctgcacagagaggaggaatctagagaggtagtctggccacagtggctttgtggtgctgcagtgggctcttcccagttcagacttcccgatggctttgtttacactgtgtggggaaaatcacctattcaagcctcagtaagggtggatgcccccgcccccccaccaagctccagagttccagcttgacttcagactgctgtcctggcagtaagaatttcaagccagtggatcttagcttgctgggctccgtgggggtgggatctgctgagtgagaccacttgcctccctgacttcagtcccctttccaggggagcaaatggtctgtctcgctggcattccagacaccactggcatatgaaaaaaaaactcctgcagctagctcagtgtctgcccaaatggccacccagttttgtgcttgagacccagggccctgttggcataggcccctgagggaatcaccaggtctgcgggttgtgaagaccctgggaaaagcatagtatctgggtcagagtacaccgttcctcatggcacagtccctcatggcttcccttggttaggggagggcattccctgaccctttgtgcttcctgagtgaggcgatgccccaccttgcttcggctcaccctccctgggctgcatccactgcctaaccagtcccagtgagatgagctgggaatctcacttagaaatgcagaagtcacccaccttctgcactgatctcgctgggagctgcagacctgtgctgttcctattcggccatcttgccagccacctgtgttactagaattttatagtgcagtatttgtcaaaccaaatgataatcatagtatttaattaagtttatatcttatcttcatcttgtaagctcttctagggcagggattgtgtcatatttttaagcccttactgcagagccctagtatgtggtaaatggacatttaataagatttgtagttgaggatgaacaaaattactttctacttttccttcctttctggccattttttctcctttttctttccaaaaaagcgtagatgtgaacattcaaattctagtagcaatctgattaaccaaagtattttaatttatatttttataagctccctggattatatttagtttctccccgactccttataaataatgataaaagccaaagagtgggaagggtgctattgaaaggcgaacataaaatattgacaccaatttcataattctacataaaaatcagctttattgctttatagtcacactttgaataatttgttcttcttaatgaatcttagttctgagtataaaatattggaaaacagtgacagcctgttgcagatataagcaaaaaactacctctctcaacctaaaaattcttactgcttcttaaacatctcatgatatgctatctggaagtgctttagctcatttactcccctgttcaaattttttgttgttgtctatgtgatttgttttggaatttaggccaggagaaaggaattttaatggtctcagtggattaatttggtaatctatatataacttgaacattgaattctagagacattcatatctttactttgctatttataacaagacagtgttaatcagtgtgctcactctttctcactcactttctcattatctctctacttcttttctcctctttattccccttaccttactttgtttcttgtttttttttcttgacagatttcagaattcctgccttgccccatgactttccattgagatctaggtagactgtattgtttatatcctgcaaattatggaggagaaacaaacctaaatagttgacgtgattttaagatcacatatcttgaattggtagaataaaaaaagaaacctaggttttctgagtcctcccagtccatgctttcaggaaacttttatttaaatatattaatctcactggtatctgaaattctgtcacaaagagttttttgattttttgtttctattttaaatctcaaagcttcttcaaataagcataagcttcatgaggactgggattgtgtttgttttgctcaccacagaatttccagttcttaatctaagccttaagaagataataggtactccataagtagtttttgaatgatgttttttgacatgttgaaattaggggatagtttaattttccatccctccctcctttcttcttttcttcttattttttggtgagctacattttctgatttttctcctattagcccatattatttatctaataaaagtattttaaaaactataccatatagcaatagatatattgtattttaaaaactataccatatagcaatagatatatgaacagttaacactttatcatagttttctttctttctttctttctttctttctttctttctttctttctttctttctttctttcctttctttctttctctttcttttcttttcttttcttttctttcatttttttgacatggatttttgctctgtaacccaggctggagtgcattggtcccatctcagctcactgcaatctccacctcccaggttcaagtggttctcctgcctcagcctccagagtagctgggattgcaggtgtgtgccaccatgcatggctaataacactttatcttagtttttcatgaaattttcggaataaaggatgacgaaatgtgatagtgtgtatcactcttttgtcaaggcctggtttctcttctgaggaatttatccttcttccttcaaattattgcctagaaatctagagcttgcgctcttctagatggcttggtgttcaccagttagtcttaagctttctgcaaacttgtaaataaataactctgtcatcttccttcaggtcctactgaaccatttctctcgcaaaggccttgccacttttttctcattatctcagggaaccttgacttctgatatggtctggctatgtgtcttcacccaaatctcatgtggaattgtaatccccacgtgttgaaggtggggactggtgggcagtgattagatcatgggggtagtttctaaaggtttaacaacatccccctagtgctgtctcctggtagagttctcaagaaatctgatggtttaaaagtttgtggcacttcctcactccctatctctttcctgccaccatgtgaagaaggtccttgcttccccttcaccttccaccatgattgttttcctgaggcctcctagtcatgcttcctgttaatcctgtggaactgtgagtcaattaaacctcttgtctttataaattacccagtctcagttagttctttatagcagtgtgaaaacagactaacacaatttcccttatgggttatttttcatagtcatcttctctgtctgcctttgactctttaaaaaatgctgcctctccattatgatctatgatctgagtttgcaaggcttattttctagaggtttttaatttttatatttttatcttttaggtaattgaactgtggttaaggcagttgccccctagtataatactggcttggctatcagtttgatttcccatgaacagaaaggaaaaataaaaattgacaatgattttcttcttgatgactattaaaatttcaaataaaaatgaaaccacaaattataaataggtaccttacacaaaggtgatacagaatatcaaataatatgctgatagaaaaggttttaagaaggtacacatatgatttgttctctattttaaaagatatcaattgattgtttgatcgagtatttactatgcaaggcattatactactgctacatgaaataaatagataaaagaaacatgaattctcctttcagcaaaacaaacactctgttggtgtcagcactgtactgaataaagtccataaacataagttgatggttgcaagttttatgtttaaagggaaaattttaaagtaagtatcctattagaagtcatccttctttattgatttaagtactaaacctaacctactttagtgaaagcacttctttctttaaggcttttacttagcagatgatgaaaacctagaacagaaagggcttaattctaagaagtgcttactatgaaaactgaattattacagctgaacaaatgtatcttgactttttgatatgatgaagtaacgtggttactgtgagaatcttaaacttcagaatataagccatttgatatcaagtgtcagtatttggtgccattggcttatacatgttactagatatttagagttaccatttaatcattgacatcattattcagtctcccagaataagaacagagattttgatgtactgattttgagtaattttatcaggttccagttcgacttgaagaaggtaaagagatgttttcgtataaatcattgattaaaatatagatgcaaaacagtaatttaatgctgtggcttggaatttctacgtttatgatttttcatccaattctatctaattggtggcatgttaataaatatgtatataaagattatttctcattggaagaataagagtaagagaggacataaagagaatgtgtcttcagtgtctagccattagccactactctttcttgctacaccatatcactatgctcagctcctcctttggagagacacacattcaaatatttaaagttataccatgaagaatgttacgttatacagaattaagtcagaattctgccaggctctagaagaaggaccaaatctttttgggaaatcagttaccatttctcagaggaaatgacatttaaggtagaactaaaacaatgagttgattttgatagaaaaggagtacagttgtgtttcagatatagttgtcttcaggttctttacataatcaatgattagttaagttttatatctttattccttatatttatagtattttcataaactgttttcgtatacattacaacatttaaattgagtagtattcttgatactacacatatttttaactttaaggtggaagtcggaaacctgacacttagattaaattcattttccttaatcatgtgtcttgtggcacaactaaaacacaagctgactccaagtgtagtactttttccatgggacagaaatgaaggaatcatattgtaccaagttgaatggttcatccccaagatataattgttgatatgttattttaaccactgaaatttgggtctgaaaattatttatttattgtagaaaactaaaagtgtaatagatacatttgaaatgagattgcgatgttaaatttaggctttatgtagctctagtgggaatgagtaaatctgatgttttctgaactatttattatccatgatccatagtagaaattttatacatttgttgtacatttgataaaactaggagtcattgtatggggattgaataatagaaaaggcagcataacatagtggttacaaggatggaccctggaaccagtctgcttagatttacatccttgttttgccacttactagctgggtgacttgggataagttacttaacctctttgtcatcagtttccctatctaaaaatggtgataataagagtctgaaaatagtatatttcctgtcaggttgttacaagggctaaacagggtattattattattattttttgagactccatcacccaggctggagtgccgtgccattaactcagcttactgcaacctccacctcccaggctgaagagatcctcctgtctcagcctcccgagcaactgggactacaggcatgcaccaccatgcccagctaagttttgtaatattttttggtagagacaaggttttaccatgttgtccaggatgatcttgaacccctgggttcaagcaatttgcctgcctcagcctcccaaggtgctgggattacaggtgtaagccaccgtgcctggacaaacaggttaataaatttgtaaagcacttgcagcagtgcctggcttgtagtaggtgctatagaggttttgattaaataagatagatgggcgtgaagcttgacagagttttatgtagtagacctgtcttgcctttccctagctgcagaaaatattgtcttttcttttttacaaacttgactatcatcatttagaaatataatgaattgaaaactggtatatccaaaatagtgtacttttactgattatgtttttcatagctatttgaacaacacttttaagccacatgtagatttcaaagtctctaaattttttcattagatcattatatcagagaacatagtatttacaaaaaacatgtagctgttttggttagtggcgactggaaatattgcttgacggtggtttaatagtgcccatactgcttggaaatattagcatttattagatagattcattttcaaatggtaataatagtactcatatagtactaatatttttcatcggtaggtttttaaattttgaccgtgaggcttttgtgcaaacctttgctattcatggtttcaagtaattttaaaatttggtctgtattttaagctaattatttagattcctagagctatacagtaatattaggtaaccattttcttctaataattactaatgtacagaagaaaagcaagaagtccaaataagtacaaagttaattaatatacatgttttaaaaaatacaataagtaattcatttttataaaacaattctgaaacatatatagtaaagagttaaatacttaccacttccttacccatcatcatttccatttttccctcctcagaggtactctctcacaggcttacgtttttacacttctataactttttctatgtgtgggaagataaatacgtattcaaatttagtacactgtttaaaaacatatttggatgataccacacatatgtttgagttttttcacttcgtaagataccaaaaatatgcctttagtcatacctgtaattgtacctcatccttaaatggtttaattatactctttattgcaaatatttccaaattagctgtttcttttttgatggacagataaattgtttagcattttctttcctctcgtcttctctcctttcctttctttcttttttgctgttacagaaattaccactgatgctgaatatcttttataaattgtttgcatgcaccctcacaacttttactatttccatagcatattcttagaaatcggattattttatagaaaaagtatgtgtgaatttttttttttttgaaacagtctcactctgttgcccaggctggaatgcagtggggcaaacttgactcactgcagccttgacctcctgagcttaagcaattctcctgcctcagctacctgagtagctgggattacaggtgtgtgtcacaacatctagctaattttttttttttttttgtatttttagtagagaggtggttttaccatgttagccaggctggtttcgaactcctgacctacagtgatccacccacttcagcctcccaaagtgctgggattatagatgtgagccacccaccatggccggcatgtttaaatttgtagcagatataaattgccctctgttgcagttccattctatagagcatacctattttccccatatataaaacattctcacaagaggcttcaacaatgacaaatttcataggtatacaacttaactctttaacatgtttccagtataacagatgaaaagtatgtctggtttgattgcactgtggtctgagagacagtttgttataatttctgtccttttacatttgttgaggagtgctttacttccaactatgtggtcagttttggaataggtgtggtgtggtgttgaaaagaatgcatatacgttgatttggggtggagagttccttagatgtttattaggtccgcttggtgcacagctgagttcaattcctggatagctttgttaactttctgtctcgttgatctgtctaatgttgacagtggggtgttaagtcgcccattattattgtgtgggagtctaagtctctttgtaggtctctaaggacttgctttatgaatctgtgtgctcctgtattgggtgcatatatatttaggatagttagctcttattgttgaattgatccctttaccattatgtaatggccttctttgtctcttttgatctttgttggtttaaagtctgttttatcagagactaggattacaacccctgcttttttttttgttttccatttgcttggtagatcttcctccatccctttattttgagcctatgtatgtctctgcacgtgagatgggtttcctgaatacagcacactgatgggtcttgactgtttatccaatttgccagccagtcaaactagaacccaggattaagaaactcactcaaaaccactcaactacatggaaactgaacaacctgctcctgaatgattactgggtagataatgaaatgaaggcagaaataaagatgttctttgaaattaacgagaacaaagacacaacataccagaatctctgggacacattcaaagcagtgtgtacagggaaattgatagcactaaatgctcacaagagaaagcaggaaagatctaaaattgacaccctaacatcacaattaaaagaactagagaagcaagagcaaacacattcaaaagctagtagaaggcaagaaataactaagatcagagcagaattgaaggaaatagagacatttcccttcaaaacgcttcaaaaaaatcaatgaatccaggagctggttttttgaaaagatcaacaaaattgatagaccaaagcaagactaatgaagaagaaaagagagaagaatcaaatagacgcaataaaaaatgacaaaggggtatcaccaccgatcccacagaaatacacactaccatcagagaataccataaacacctctatgcaaataaactagaaaatctagaagaaatggatatattcctcaacacatacacccttccaagtctaaaccaggaagaagttgcatctctgaatagaccaataacaggctctaaaattgaggcaataattaatagcttaccaaccaaaaaaagtccaggaccaggtggattcacagccaaattctacgagaggtacaaggatgagctggtaccattccttctgaaactattccaatcaatagaaaaagagggaatcctccctaactcattttgtgagtccagcatcatcctgataccaaagcctggcagagacccaacaaaaaaagagaattttagaccaatatccctgatgaacatcgatgcaaaaatcctcaataaaatactgacaaaccaaatccagcagcacatcacaaagcttatccaccatgatcaagtgggcttcatccctgggatgcaaggctggttcaacatatgcaagtcaataaacataatccagcatataaacagaaccaaagacaaaaaccacatgattatctcaatagatgcagaaaaggcctttgacaaaattcaacagcccttcatactaaaaactctcaataaattaggtattcatgggatgtatctcaaaataataagagctatttatgacaaacccacagccaatatcatactgaatgggcaaaaactggaagcattccctttgaaaactggcacaagacagggatgccctctctcaccactcctgttcaacatagtgttgggcaatcaggcaggagaaggaaataaagggtattcaattaggaaaagaggaagtcaaattgtccctgtttgcagatgacatgattggatatctagaaaaccccatcatctcagcccaaaatctccttaagctgataggcaacttcagcaaagtctcaggatacaaaataaatgtgcaaaaatcacaagcattctgttttttgttttttgtttttaattttttattatactttaagttttagggtacttgtgcacattgtgcaggttagttacatatgtatacatgtgccatgctggtgcgctgcacccactaactcgtcatctagcattaggtatatctaccaatgctatccctccccccctccccccaccccaccacagtccccagagtgtgatattccccttcctgtgtccatgtgatctcattgttcaattcccacctatgagtgagaatatcctgtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggagttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggattcttatacaccaataacagacaaacagagagtcaaatcctgaatgcactcccattcacaattgcttcaaagagaataaaatacctgggaatccaacttacaagggacgtgaaggacctcttcaaggagaactacaaaccactgctcaatgaaataaaagaggatacaaacaaatggaagaacattccatgctcatgggtaggaagaatcaaaatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtatcaggctacctgacttcaaacggtactacaaggctacagtaaccaaaacagcatggtactggtaccaaaacagagatatagagcaatggaacagaacagagccctcagaaataatgcagtgtatctacaaccatctgatctttgacaaacctgacaaaaacaagaaatggggaaacaattccccatttaataaatggtgctgggaatactggctagccatatgtagaaagctgaaactggatcccttccttacaccttatacaaaaattaattcaagatggattaaagacttacatgttagacctaaaagtataaaaaccctagaagaaatcctaggcagtaccattcaggacataggcatgggcaaggtctttatgtctaaaacaccaaaagcaatggcaacagaagccaaaagtgacaaatgggatctaattaaactaaagagcttctgcacagcaaaagaaactaccatcagagtgaacaggcaacctatagaatggaagaaaatttttgcaatctacccatctgacaaagggctaatatccagaatctacaatgaactcaaacaaatttacaagaaaaaaacaaccccatcaaaaagtgggcgaaggatatgagcagacacttctcaagagaagacatttttgcagccaaaagacacatgaaaaaatgctcatcatcactggccatcagagaaatgcaaatcaaaaccacagtgagataccatctcacaccagttagaatggtgatcattaaaaagtcaggaaacaacaggtgctggagaggatgtggagaaataacacttttacactgttggtgggagtgtaaactggttcaaccattgtggaagtcagtgtggtgattcctcagggatcaagaactagaaataccatttgacccagccatccattacttggtatatgcccaaagtattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactaacgcaaggacaaaaaaccaaacacagcatattctcactcataggtgggaattgaacaatgagaacacatggacacaggaaggggaacatcacacaccggggcctgttgtggggtgtggggagtggggagggatagcatttggagatatacctaatgttaaatgaagagttaatgggtgcagcccaccaacatggcacatatatacatatgtaacaaacctgcacgttgtgcacatgtaccctaaaacttaaagtataataaccaaaaaaaaaaaaaagaaaaagtatgtctgattgttggatatctgatgaaaaggatatctgatatcttaatttttatttctttgttagcaatgttgagcattttaaaaataagttactagccaaataactttttttctgtaaataatctattcttatcttgtctatttttttatagtcgtttatctatttgccaccttatatctttacttggatgtctaatggaaatctcagtttaagacatcccaaactaagtttcctttcttctcaaatgtgcttttcctacagctccattcttccagtctctcagtcctaataccttggaatcatctttgctttctcttgtactatacatctaatccatcagtaagtcttattggttatgtctttgaaatggatacagcattttaccacttcttgccacctcgttgcttctgctgtctcttacaacctgtcttcctttttcaacactggatacatgtagtaaatgttttgcacagtagccagagaagttctttcaaaacacatattcaacaatgtcatgactatattcagaatctgttattctgtcccagttccctcaagtaaaaaccatctccttactatgacctacatgagccctgtatgacctggtccctatatatagctctaacctcatgtcctacttttctcacccttgctcactctgctgaagccatctttgcctccatactttgcttgaaaatcccatgcatacctttaacttcagacattcgttgtttttgtttcatctgactactataatgctctgcccactgagatctgcatggatctcttccaaactggtttgctttaataaactttatttacaatttctgatattgacaatgtcataatatatgacaatataactatgagaaagaaaaagtccgttcttcatgcccttaaggtattttaaatatggtatcaatgctcatatattaaccaagttagggggagaggggaagtatgagtggatatggcaactagtcatatatcaccacattctcatagtagtgatatggtactacttattttggagagcatcctaggttcttcaaacttaatttatttaggtctgatttatttattttatgctactttataagtacctaaaatactacatataaattatgtatttgaattaacataagctgtattatataaatgtatccagttttaaatgaaactgtttagttataatacattactataaattactcaattgtttaaaataattcctgaaatctttcattatgaaaacatggttgaaatcctctaatttctttacttggaagaacaaaattttaaataatatagggagtggaatattacatttcattttattaagaaatcttccttttatgtaatcacatacctcttttggttatcatcaaaatccaccccccccccaactttttttttgttgttgttgagacagtgtctcactctgttgcccaggctgtagtgcagtggcgcaatctcagctcattgcagcaacctctgcctcccgggttcaagtgattcccctgcctcaggctcccgagtagctgggattacaggtgcctgccaccatgtctggctacttttgtagttttagtagagacggggtttcaccatgttagccaggcttgtcttgaactcctgacctcaagtgatctgcctgactcggcctcccaaagtgttaggattacaggcgtgagccaacgtgcctggccaaaatcactttttaaaattgagagattttattggtaagtttttgttatcaggaacatttacatatgggaaggataattttctatcaattttggatgaatcaagtgctttttagttgaatttctctttttcttccaagaaaagattttattgatgtattgcctttatactgaaaattggacaagttgttaagttactgcttaatgaattcttacaaagtgaatacttgcatgtaattaataaatagaacgttactatcacttcacaagtctaccttctagtcactaatccctgacaagggtgaatgctctcctgacttctaacaaattaggcctgcttatttttgaatacttgcaaaaatcagttctataagagaaaatgatgtaaaatgacaattcataatctcatataaaaattataattttaagcaaggaaagaaacaatcttgaaaatacgtttggtatgttctgtgaaattgtaagttatgtttctattaaataattagctattctcgtactcagaatcccgcccattgtcagttcctgttaaagccatgttgaatatatctgaaagctgtagaagtcctgaagaaagaatgaaggaatttattggaattgtttggaatgcagtgaagcatctcacactacaggtaaaataaaagttagaaatattatggatataatttctataatcctttttaattcccagcattgttaatattggtaagacttttctcacatgtaacaattatgtataccatctcattttcttaatttagttgaaaataattggtgtacttcacttatcctaaacataattttatgaaactcatatgaacttccttatagttataaaaatttacacattttgacatgtttcttgacttaaaaaattttagttcattctactttttgtttaagcattattttcacaattttaaattcttagtgttcatatagttccattcttatctcagaactgagataaagtctgagttggaattaaattaacatgaaagggttatctaattattttttctacataattataagttaaatatgaaaattataatagctatttccttattgttattttcctctcattgatttttactttaaaatgcacaattttatcttattgaattactttctttcaagatcatgtttaacctgactaaaatatacaattagatgcttatttgataagctaacagttataaattttagtttttgcataggattttttctctgtgataccagagacatccttatagaattttgtatgtaccagagtgtaatatcaaaggcttaagtcaaagcttttcaccttgacttaagatataaaagttgcaatagaaccttgttcccaccttactatgagaacaaggttttgtgatctgcaaaattacagctatattaagcccatagagatctgaggtcttaaattgacattaccataacagcagggtgctaaaatccaaaaaagtgacaagcaactcactttttgaaactcaacaatctcagaaaactccaagaagaatatataaaaaggaaaacatagctaagtacctagtagtcaaactactgaaaacttacggagaacgttttattttattttactttatttaaagtgggaagatctttatttatcaatattcttgtttacctgaagactatactggaagaagctgaaattataagtaaggcagacctagatatgtatttcttagcaatgtaatattggagagttttttcttgtttctgtatccacaagttggagattataatatcttcttcatgaagagggtcgaaaatatagagtgataaagtatataaaagcaactgacaaaatttattcatttattgattcattttgcaaaagttaccatactgtattcagagaacatactgaagaaaactaatgcagtcctgtcctcatgaagatcatagtttggcaaggagagatattcattaaatgattgtacttaaaataatttgactataatggtgatgatcctgcttcatgaacatacgtgtcaattaagctaaccctagaagaatcaggaaacatttgggtactcaataacacttgtgttttctttctctattccatctttctctcctgtagctgtagcttttttctaaagcagctgaaggctgcactgcccttcagcaggcagacaagaagtgatggagataacacccctgggattatcttcacccaccatgggaaatgattctgtggcattccttgtctgtcagtgtgtcctcagtagaattaagctccaggtgtccagggcttaccagcacacccattttggttactgtccttttgagaaaattttagaagtgggtagacagtaaaggcctgttatatacagattaaaaacattaagaatgactccttacatcttattagaaacaatggaggccagaagacaatagaataacacttttatgtgctgaggaaaatcagcacataacatagaattaacatagaattctctagtcagcaaagtattcataaaaatgttggccaataaatacataaagacagaacttttctctaatagaaatttactgcaagatattctgatagaagttatttaggctgaaaggaaattataacagaatcttggtttttcagaaagtaatgaagtatatcagaaagtataaatagttgtaaaacaactgaatattgaaaaaaatagtattcaaggagaaagctttagtgtgttttagtcttttggctgttagcttctttcctcttcattttccagttaactttttgtttgtttcttttttgtttttggacagaatcttactctgtcgcccaggctggagtgcagtgatgcgatctcaactcattgcaccttcgcctcccaggttcaagcaattcttctgcctcagcctccccagtagctggaattacaggcgcccaccaccacgcccagctaattattttgtatttttagtagagatggggtttcaccatgttggccaggctggtctagaatttctgacctcaggcgatctgcctgtcttgtcctcccaaaatgctgagattacaggtgtgagccactgcactcagccctagttaaatttaacattaaaaaatatatgacacttaacaaagtaaaggagttttgattaagatcaaaattcagcagttaaatgaaatttcagtaatttattcagaaaatatttatgaagtccctggtctgtcctacactccagccagcccttagtcctacagatgtgaggaaattgtctctgtgagcaactagagtgagtttggaagtgtattctttcccaggtgagcctgtggatgaaaacacagatggtcaacacttttattgcggctttttgagaccataattcaagtatttaactaagccataccaagattattgacccacagaaactgcaacaaatgtctgttgttttaggctgttacatttgtggtgatttcttatatagcatagaaaattaatatagacagatacagacacattatgcatagctatagtgtagtctgattaatcactataagaaatacatacctgccataaaaactttttagaaattcatccaaaaatatctccagtgcataaaaatactagttaatataggagccaataatcttgattttagcattcctttacatgtttcttttctgagcatgcctcttataagaaaattaagagaagaatggggggaagaaagtatggcttgtcgttcttgtgtaattaactcttagcttgcagagttatgactcttttagggatatcagctatatttcaccagtctcagctgtcatgattccttgtaatgaatatcctaataactccttgcattgacttacctgtccttctcccttagaggtaccctttgtacagtggtaacatccagcacttaatttttgttatatgttgggctatatgctgagaaaaaaaaagagacataatagttgtcatggtctagctgggaaaaggctaagtgccatggtatggagtatactgtagggagccccttagaaaacttaacgatgaaagaagagaaatgggaatgtcaagaggaatgttacttattgaaaggatgcctagggcatgtacttcctggtttgtgatgaatttagatattatcctaggtaagtatttattgctttgtagaagatctagttgacaccattgtgtggtttagaatatgatagctaccaataatatttagttgtttaaagtttactatagatctaaatgctatttcatgataatagaagtagttatattaaaaataacctcattccctcttatctaatgattgaataatgtggtataattatccttttattgatatcattttgagtagttctgtaatagggaacatgaaagatagtattggattacatgattatttgacaactctgggaaaatattccaatttaagattccaagtaatatcagaaatctttgcactatcgataaacaagtaggtacatcaatattccacaatgtaggatatactggagaatgtccttctctggccaggattaaataacaggaataagatttatttcactgcctgaaataaccaaaaaattattgaaatatataacacaaagatttcaaaccactaggcaataagccaagtagacagtgattcctcagagacttaagataaaatcagcaggacttagtaattaattgatttggggaatcaaggaacagagtctaagagatcttctagattcttgttttggtgtttgggtggtagtgatgctattaaatgaagtagcttttccaggttaggggcaaatagggattttgaatttacacatgtatttgaaatgtatgtgagacatccaggtatgtattagatatttacatctggagtttaaaaaacaggttaagagaagagatataattttaggagttatctgcagatggttttcaaaccaggagaatgggtcattcaagaaagtatgtacagttgaaagagcaatgggccaagggaataccgttttaaaagttgttagtagaagagagaatgtccttgaagaaaattatgttagtgatcagaaatggaggaggagaaaccagagagttcatgaaagcaaaaaatgcttagaattttgaggagctactggtcagcaatgtcaaattctagatgttaactatgtgctttacttgcttatttgtagtataaaatggatacattaaataatatttaaggttacttccaactctaacattattgtatgattcttttgcttattttataatgttgcagtaccttttagcttcatcactaacaaacttaatcttatatatcactttgaattaattgtaagttatgatagtgattttcctcatttttccttttttaatctctaattatggtaaaatacatataacataaaatttaccttccttactatttggaataaactatatggtttattttgtggttcctcaatttgagtaagcttattgagtatcagttaacataatcattgcagtaccaaataatacatctttatataggttatcttatatatgacctaggtacttggcttgcctcaccctagtcctggccctgtgttaaacatactatatatttaaacatttccagatgttaatgtatcatcaacactttaaaagataaaattagattctcattaaatgattacaatttagactgtgaaaatctgagttttatttattttatcttattttatttttttgagacagagtcttagttgtcgcccaggctggagtgcagtggtgtgatctcggctcactgcaagctccgcctcccaggtttatgccattctcctgcctcagcctcccgagtagctgggactacaggtgcccgccaccatgcccagctaatttttttgtatttttagtagagacggagtttcaccgtgttagccagggtggtctccatctcctgacctcgtgatccacccgcctcggcctcctaaagtgctgggattacaggcgtgagcttttatttttaaaaacgttgtccattttttaagatgttttatgagccaaaatataaaacagaaaaccctgcaagttatcatcagataaaacaggacatcataacttaaaggtttcgaatgattattcttttagtggaagtttgtgcaggtaattatgtttggaaccagaatttctgcaaagttgatgttggagccaaagttggtatttgctaaacccatattattttttacttagaatagaaacatgtatattacataaaatcattaacaatatttgctgtaacctatttgtttttcagtgtggaagaaggagtttccatacttaattataatggattattttataatattccatgtagtcttggacagtctttttttttaaaaaaaaatatatatatatatgaactttggggccaggcacggtggctcacatctgtaatcccagcactttggaagtcctcggcaggcagacgacttgaggttaggagttcaagaccagcatggctaacatggtgaaatcccgtgtctactaaaaatacaaaaattagctgggcttggtggtgcccacctgtagtcccacctagtctggaggccgaagcaggagaatcgcttgaacctgggtggtggaggttgcagggagccgagattgcgccactgcactccagcctgggtgacagagcaaaactctgtctcaaaaataaaaattaaaagaataaaaatatataaactttgggggccttttaacaatagattagcataagttcaccggttctttccaagttttctatacctgctcattaacaaagattctattaaagctatgtttttattccagaagcacataattggcaatagtatgtagctgataaaatagaaatgtgctggctagaatttactcctttctaggagaacatttctctgcttattgccagacttagctttttttttggtcatttacatcgaagttcatcttgctgtcctatgacatgtactagcattttcttttcctctttttttttttttttttttgtactctctgagtttttctgagtggactgaagtcttctgagtttaatggcatttttaatttcaataccaagcattctggtctctttcttttggtaataatgctgttattcctttagggaactacttcccacattctgtgttattttgatgagagtgtcagtcagggtgtctcaagcagcatgagccagttaagctgggccagttgaattctgtcttctaggaagttaaatctagagcatgactagtgatgaaaaaagtcatactgcttgatgtcctgatgtccagtaaactccttggcctttattttcaggattaaatgggagtagacattttaggccagagagatcaactatcaatcatgctaattataaaagtaagattttatatttaatccttacaaattttgcacacaggcccacattcttacttataggcattgaacaagtgacagccattgcatggcagttaggaggaagtctggaattcaaatctaggaatttttaatgtcttctcttgacaagatttttatggaaaaagtgtgaagatttataacacttactctggaaaggatgacaaccaagacaaccaactgtaggcttttaatctatggccccaaatcagggatatttaaatttctactacatatgatgatatccaaaatattttcatgatgcactgaaaatttatcaaataggaaaactgtgatttgggtgatagtttatatatttgttgtagtgcaaatggaatactaattttaatggcccctatatacagagatagtgaaaccgtaagcaacagcatttgaaaataaatgcactgtgaacaggttttataaatctatgaggctaataatatatgggatctcgcctataggagagacttggtgttgtttgttgactatctttctttagcaaacgtttaggtaacacttactgtgttaaatatatatatcaatgctataatttcccccattaacagatgaggaaactgaagtcatggagagatgaaatagcttgtcaaatatcccacagctgtgttgaattcatctcattaacaaatcagttttattaatcaccttagaggttgcctctggaatgaaatgatgaacaacgtgcatgaagcaattattttcattaccatatctgatgaaaataattgtttaattgtttctacttgttgaacaattatttattgagtacatagtacatgcaccactgcacaatgtacagaaactatatagtgtacaaaataggcaaatgtttgacttcataaagtttatgttctcgtgagaattctgtaaggatattaatacttgaaagtgatcttgttttaagcttttttagggctggcactatgtcttttgtctctgtattcctgacttccaggtcagttcatgatagatattagagagtacatgaataaaggagagaaaaagtaatgaaatgcaacatacaatgttcctttatttttgttttttatttgaaactctttcctgaagagtaacatacacttatatagagaacatttggtactgtagaaattatgcaaaatataattatcactacattttcaagttgtaaataaaaataaatatattatttgggaataggaaatagttatgttattgaaaagggaagaaaatgtggcacaacatttcaaagcttttatctataaagtgctttatatgatgggcagtggctaattaagattttcagattaatgggtaaataaaacctatcttagtctcttctttttagctgaattgggatcacaattatagagcactaaaagagaaaaatctaagtttctcaaacctcacatatagggccaaggacttacagaggcatatatctttcaaatagcacataaactagaaacttcagggaaaaatgcattgcagtcatttcatttattaaaataagaataacaaataatttttactttattggtttatcttcagtatatgatacttagatatgtagcccttgacctagtaggaatcaaaatagaggtggttccacttcaagaatttgtaataatcccttcactttaacacatgaatgtgttcagtattggcaaaagaacacgttgctaccaaaactgaaacaagatccttgaaacagaaaggatgttgccatggaaaaatgaagtaacactcagtgcagctgtgatgcattcatgaataggatatttttttaaaagatcatttgtgtttggtgtggctcagagggtcccaaccagatggtttccatgaacatgatctgacccccagcttgaggacttcttactggcagattacttcattttctttcccttggattgtcagatccttacattaattcagaatttactgctgcagatttatattcagtaatataaatcactcaacattttacattaaaaccacaattttatacatacagtttaacagttattttaaaagtgtaaaaagatttatgtgatagctttagtatatataatagataaaacataataattttgagtaattttaattatatgattcttatcattaaaggaactctcacaacatatattttagaaagtttattttagagttgttatgtatctgatgctactatactgttgattctgtttatgttgctcacattgtttacacttgatgaaataattgatttttaaattagtgaaattaatgtttttgattttggaaattttggcatgatttgaattttttcctaaggatatgtatgcatgtggttgtgtatggtagcatactaaactaattacctcacaatattgaaagcatttttcaaggtagtatcaatacctacatgaagtgttaaatactgacacttcatattttgaccttttaacctgaattaataaaggctatgctcttaatgtgccattttaaattgtgcaactgaaaattactaatgaattatgttaaatattttaaagcataattctaagttacctgagacaatatagacttctatttcagaataaactacatcatgatcttaaatcaataaactacttaacacacatgtactttatctaatctgcagtataagattttagaactaaaatgagctcatgcttcacaaaccaatgcgtttatttttgcaaaattttacctgtatttttcatcactgaattcatcagtttggccatgccccaaaatgtgaagcaaagacaaacaggtttgtttatttataggttgacaaattatttatcctatcaaggaattccaaacctgttaaatataatcatgttctcaccagaatagtatattaggcccaagagaagagatgttgctattatcttttaaaaatgtagtctttttgctaacatagtttctttgaatatccaagaatgtatgaattaaaaaaattattttgtatcacacctccagataacatatttttatgtgaaatattttgtaggaaatcaaccaatcatagtttgtattttctcaataacttaagtatcgtaggctgttggagcaatttgataatgagatacacagtattactttataagcaccgctaagacaaatagactttacattgcttctgaattaagaagtcacgatgaattcagttttggggttgggcttactttgtctccttatcttaacctctgaggtcctggcaacttaatgtaactctactggggataggagaacattaagataatacatgaaattacaatttaggtaatttgaagaatgaaaaaagcaagaaataatgctctgatttttaagtcttctgatttttcctattatgatgtatttatgtataataaatctgatacatgtatgtatacttgaatcattgtatataaaagtgaaagtatgtgatataaacatgttctttaatggttgtctagtgttataaattgaatgttttaaacaatgttttcttatattctagtctgtaaagtaaaaatggaaggactaaattcacgtaaaaatagccctttttaaaaaaagtaacagcaataaaatgctaggtagttctaggccttatctggtgttaacaaaattttctaataaactgcaaaagaaagagtgttttctgatcttcttttgccagcacactttctaactcaatcttgtgtcttggaaaagactgtggaagggcagatcatctcttgtcactaggcattttgtatcaagtttataacaagagtaaacaataccttttcaagtttttaaaatattcattagtgaaaataagtcataaagacataaatatggaacatttactttttttggttgtttattctggcgaagatgttaggtgtttgaaggcatatttagtctaatccgaatattttaattctgcttttcttttctagcttgaagtacaatcttgttgtgtgtttattccaaatgatagcctgccttccccaagtacaattgtatctggtgacattcctggaacagtaagaagttggtaccatggacaaaccagcatgccgggaacacttgtcctctgtttgcctcaaataaagattattagtgctgggcacaagtatatggaacctctgcaggagattccatttgttatcccacgacccatccttgaagaaggtatatgttaacatttttttcctatggttaatgttttatatggacatttttagatttgttggtgtttttaaatgtgtcagtgtataagcaaatcagtcttctcattgaaagatttttcctgaccaaagtaagtgaactaagtgatgccatttattgccttccataccttttaatcttagtcatatattcacatatgttatctgtaaaagatcatatgcaatataatataatcattaaaatgtaaacgtaggaaaaattaacttgggaagaaaattgcttttggatattatcattaggctgaactaagaatgataagtagattgatcttaatttaagttacttgatttatgaatgaatgtattttaaatatataaataattgcgtgaatatattatttagcaagcataatgtatttttagattcctcatttgtttatacaaagtaattatatgatgattagagtcatgatcctttctccaatatatatatacttaatttctcatattgctgtgttttcagttatgaattcataaccttttgaactttggcatattcatttcaaacaaaatgtgaacctggaaagattttgagtcataaagtaatctgaatatatattataataacaaggctcaaatttttgacagtgctaaacaggtcaacaccttgttcatattattatggtgtaagtgtatgaatcctgatatcactgaaatttctacatactgtcactgaaaagcagacatagcctgtgtaatttttgatctctactttgatgttgatttctctctccttttctctatactgaaatttctattgaaatctacttttcttatattcattaaaagaaaacatgatttcactgagagacatttttggtccttaataacatgaatactattatcatacaattatagaattttaaggttaaagggaatgtttttagagtatatggtctttttgtgactggtttctttcatttaatatttttaagattgattcatgttgtagcagtctttgttgtttttatggctgaatagtattccatcttatggatatatcaaatttttttgattcattcatcagttgatggacagttgaagttgttttcactttttggcttttatgagaaatcctggtataaacattcctttacaggatttttgtgtggatttgttttaatttcttttagctatatgctgaggagtaaaattgttgtgtcgtatagtaactatgtttgagcttctcaggaattgccagactgtcatccaaactgtctgcaccattttataataccacattatgtacaaaggttctaattttttcacatctgtgtcactatttgttattatccgctttgtttctttttcttttctttttttttttattttgttctagccatcctagacaataacctcttaaactggagagagcaattaattttaagtggtttgtttcttttttttcttttttttcttttttttgagatggagtcttgctctgtcgcctgggctggagtacagtggcacaatcccggctcactgcagcctccgcctcccaggttcaaacaattctcctgcctcagcctcccgagcagctgggactacaggcacttgccaccacacccaggtaatttttgtatttttagtagagtcagggtttcaccatattggccaggctggtttcaaactcctgacctcgtgatccacccgccttggtctcccaaagtgttgggattacaggcgtgagccactgcgcctggccaaattaaagtgtttttaagaactgtgttggtcaggcagagagtaaatagattgatttaatacatcatttaatatactaaatacacatcttaatatttataaaactgaagcttacattatgaaactggtgtttatttttactataaaaatagtaaaagtggtgtgaagtggaatctcattgtggttttggtttgcatttccctaatgactaataatgttgaacttattttcgtgctggttggccatttgtatatcttctttaatattttatttctttttatttatttatttttttggatcaggtttcattcttgctgaggctgaagtgcagtggtgcaatcacggctcactgccgccttgaccgccggagctcaattgatcctcccacctcctgagtagctgggactacaggcacacactaccatgcctgtctaattttttaatttttgtagaggtggggtttcaccatgtttcacaggttggtatcgaactcctgggctgcctcagcttccaaaagcactgggattataggtattagtcaccctgcccaacctaatattttcttctattcaaatcttttgcctactttttagttgtatttttagtagagtcagggtttcaccatattggccaggctggtctcgaactcctgaccttgtgacttcttacagttgagttgtaagagttctttattatattctagatacgatacccttacacatgatttgcaagtattttctcctgttctatacattgtcttttcacttccttgatggctttctttgtcatataaacatttgtaatatgaaatttttataatatgaatatttatattataaatttatataatataaattgatattataaattttgtagtataaacatttggcaagacttcatctctacaaaaaatttaaaaattacccggttgtggtggcttgagcctatagtcctagctccatgggaggttgaggtgggaggattgctggagtccaggagttccaggatgcagcaagctatgatcgcaccactgcactccagcctaggcaacagagcaagaccctgactctgtaaattaattaactaagtatatataatacatgatatataatatgtaatatatactttttttaataattataaattgtataaatatatgtaaatataaacataatctaaaaagttttcctgtgctatgttggaaattattttctcactattcttttttttaatattagaaattaacaccatttccacaaagtatgttttagttttagaaatattaagatgcatatttaatttatttaatgatgtagtaaatcagtctatttactctccatctgaacaatacagttcttaaaacactttaatccttctctccagattgaggttattgtcataaattttcttttatttttaaaacttgatatcattattttgtaatataattgcttagatttggcatatatagaataaggcagaggttggaaaactttctcaacaaagtgccagatagtaaatattttgtttcattagctatatggtttctgttttcactacccaaccatgctttatagtgcagagacagccatagacaatatgtcaatacattggtatgactgtgttccaataaaactttatttacagaatctggtggttggctgcatttggccatgagccacatttgcctacctatatgctagtgctttagtagtcattccttttcacagcttagcccttccttctttctcagttcatttacttctgcctaaagtacatcctttagaagctgtttttgtgatggcctgatgttagcaaactctcaattttgtttctttgcctttttttttgaaatatattttctgggtatataaatccttgtttatagttattttctcccagctcattaaagatactgttgtgctgactcttgcttttcattggccttttaggaggtacaatgtcatttcatgtttccttggaagtcgtttgtccttttcctctgggttctttaaggatcttctcagtctttgtgttttaaagttttaatattcgaatcttatgagtcctgcaagttttctggcataatctattcagatattgcctttactttttttctttccatacatatgttggacttttttgattttttactgtattttccatgttgtttcttcactctttgatattttttctctttgatttgctgacctgcattccagttaatttctttaatctagttcattaattttcttttcaattgtgtctaatattttgttaaagttgttctttgaatttttcaatgtcaactgtatgaaagtctaacatacagaaaatggtacaacgctaagtatacaactggatacatttttgtcagataaatccatacatgttactagtacctgaatagagatcaagaatattcccagtactcagaagatcttctcttggaggcaaattgtgtttaacatctaaaaccgcaaattagttttcctgtttttgaacttcatagcacttattgaatagcacttttattgaatttaaaattttacataggatattctttttatcttgattctatttaaaactctttattaatattttcaaggcttccttttatctctttctgcatgaaacttttaacttacgtgattgcctaattcctgctgactcttgcctactatacctaatattccttgtttatacttttcttttctgtgctacttattttccttagaaatttctctgtagaaatgttttgaagcctggcctgaaagattcctcctatacaggcttgaatttacttccaacatgttggtggcactatgagttcagaaccatttgaaactaaattcttgataaaaggtttttatgccacttagataataaaaatttaagctacagccttgtggttgtgggttttccccccacccatctattgaaggtttcattttctggcagcgtttgtgagaggatcatataaagaagggaagagcagaaaactttatttctagtttacctgtacatgaatattctagccatttgcatgccagctttatcttttattattttctgcactgtgagttagcttcaggctttatcttcagtcagacttaacttgacttcagttcagtggtaaacacggatgctcaattttaaccaactttgaagtgcctcgggcatttactttgcatacctctgtgtttctggtttccctcagcccctggctttaattatctttactctttttggaaattcattaataagtttaagaagatatcatttggtgtgtgtgtgcatgcatgtgtatatgtgtaaaacattatataaattttatagtatgtgtcacatattgttaaaatacagtatagtcatttttatttttttaggagagggatcattcaacatatttatcgtgttgctgtaaatagaattcctcagttatgttttttaaagatgatgtgacactattatactctgtcttttcaaatgattttataaaaggaccgatatatagtgcccatcattctttataccttcaatactcatttaaaatctctcttatttctacaaaactcctgccaacatctactgcttgtctttttcatattaaaaaattattttattttcatcttgtttttcaagtacatcaagaatgacttaggaactgcggaagtctccatctttaaagcataaggtgctattatattctcaggtggttttatttttatttatttatttatttatttatttatttatttatttattgcaagaactgagatggcaacttaatttattttgaacttaaaaaaaatcacataccagatggagagggcttgaatcaaattgaaatttccagtctatttttcatactccctaagagaatatagagtgactgcataatcaacattgaaacatgaagtagaaacaactttttaaccacatggttattctcattgaccaaacctactctgaggaaaagagattatttcaagatatttaaattctcttttggtcttaaaaaactatagaaattaacttcttatgaataaccagaaatctatccctttttctgcatttaaaatggtgtttataaaaatattataagcctttgatgcatacgtgttaaaagtaatttactctttgtctttacacatgtacccagatagaaaactgatttggaggtttacttactcatttccagttttcacacagcccttctggtttcagtgtcatgcctgtattctctttttcaatctttcttgagtattgggactgatggcatgaattagactgctcttttatagcttccttctctggtcctcagtcatttgctatttacacacattccagctttaaaaaatttgtgatatatttcatcttcagtcatttcctctcttgttcttattagtcctttttgatttataatgctttttccatttcattgtcattttgttggtttcaaaatgtagataactttcaatcatttatgttcaagcagatacaggatgtctgaatccattccacctcctattatacccctttccattctacttctctgatactattgttttatgtttagctcatttttgttcagtaaatgtttcttagtaagtatagaggatggattgggggtaattggataaagtaggaaacctggagtcaagattagttaaatattccagatagccattatagcttagaagaaatgattgtcagaaccagggcagtggtaatagatactgggacagaatagagagaaatatttaaaaggttgacaaaaactgtccaaacttaatgactggattagttatggatagggaaggagagaaaaaaatctgtagaataactccgtggttcttagcttagatgtcaatatacattatttacatagttaatattatggttaggaacaaagaaagagggccagtttttggtgtgcatggtgggatggatgaatttagtttggtccatatggtgaagtatccatgggacatttaagtaaataaatctgatgagctgctgcatatatggatctagagctctaaagagggatcatagagacacaaaatgaccacagggaaaacatgaaaaaagataggattatccgaagtcatttatagagtgacaaatgaagtgggatctgcatataacaaggcagggaacgtaatgttatgggatgagaaaggaaggaataatttgtgatggaagctaccaatagaaggtcaggtaagtaaggaaaactgtgaggaaaaactgtgaggcactagtcttatggcttaagacgtaagattggatcatgtataaatgattagatcatttataaatgtagccaataagataaggactaaaaactataaggtttcacaattttaggtaactggtttcttttatcacagtattttcagaagaatgatttttttttttctttgagatggagtctcacactgtcaccaggctggagtgaagtggcacgctcactaactgcaacttctgcctcttgggttcaagcaattctcctgcctcagcctcttgaatagctgagactgtaggttcgtgccaccatgcccagctaatttttgtatttttagtagagacggggtttcatcatgttggccaggatgatcttgatttcttgacctcgtgatccacccctcttggcctcccaaagtgctgggattacaggcataagccaacgtgcccagcaagaatgattttaatgacagtcagtgatggtggcttgagaactgaaaaggaaatgaagaactaatttaataaataatttgtttaaaaatattatttgagaaatgacaggagaaaaaggatggttcctgaatgtatatataccttgatattgtttgggtgcaggaaacagaaaccaagtcaggataactaaagcaaaaatgaaacttaatgattcattgtctatattctattatagaaaacaactttgacttttagttaaaattttaatattactcccaccatctgactctggtggttatgaagaccatatgttcaattaaaaatttcttttctgccacgtgtggtggctcattcctgtaatcccagcatttgggaggccaaggtgggcagatcacaaggttaggagatcaagaccatcctagccaacgtggtgaaaccctgtctctactaaaatacaaaaaattagccgggcatggtggcgtgcgcctgtagtcccagctactcaggaggctgatgcaggagaatcgcttgaacctgggaggcagaggttgcagtgagccaagattgtgccaccacactccagcctggtgacagagcaagactctgtcttaaaaagaaaaaaaaatttttttctttatcttttttttacttgtcctcataacccctgagaaattatttttctctatctttagaattgcttgtttatcattctgggattccaaatttctattaaatttgcaattctttgaaaccaattatttagattcatgatggaatagaccaaaaagaacacattcgtatgtaactaagattatatactcaaaccttttattttttatggaaatattttggtatattgcatctgttaatatctgactttataagcagaaaatatggtacaaaatttaataatttaaaaaattactcaggattatcattgtgaatgcaaccagaataataaatgagacctctttatttataccttcaaatttttttagtatactgaggaatgtaaaaatgacataaatttgattccagtacaccttgaaacataatctacaactttacaggtaagggagttagttggcacagcattctaagggtgtctgtttttttcttttaattcctaaaacctaggctgatacttccttcaaccatctgtcctctctatcccactcaatcctccagcctttttttgtatttctttattttcctaaatttcccttatttgtcccattcattcaacaaatacatattgagcacctaccatgtggcagtcacatagagaatacagatttgaacaagacagatatggtgcttgcttgttgatatcttacaagctattgggaagagtagtgcaataaatagtccttggttgaatcttatgtattgctggctattgatatcttttcctagggtaactaaagattaaatgagatatacattactttgaacagtgtctggtaagtgctcggtaaaaaccattatggttctcaacatccatgtaggatttccaaattccatggcctggttttcaatctttgctgtttcccagatacattttctttccttggtctcttctgctgccatgttcctggaaccctgtatggaactctatctccgtaataggcttataactcttcacttcctttaattcacttatagaatccactcacaaagaagtattaaagaatgaagtagagtttgctgaagatgtcctaccatagggaagaggtggtactggtgtaccctgtatcaaacggtgtttaaagtggctgttagtctcttagacatgtttgtacaacacagtgcttatttggcccttttctcttcctctttaatctcttgaccaaagtaatttgaaattcctctccttttgtcatgcagagtaatttagttatttttgcgtgcaatccttttgatggcttcctttcagtcttagggtacatttaaaagtccttaacatgaccaagaccccatacgaattggccctgcccacctctccagttgtattttctgctacactccctgctgcttgctttgcccacctccagccctagtaacctttctgtgttcttggaataagcacagcgctgtcctatcacagtgccttagcatatgctacaaacatgacttcatccttcccaatctgtcctctaggcatctttctccttctcctccttcaggcttcagggcatttcatttatcaggtccctccaactctgtgctgtctttgtactccagtcatcacttttacaaactttatcctaattttaactatttttcttcagtatctgattcccctactagggtgaaaagagcaggagccatacctctcttgctcgttgctgtattaccattatttagcacaacacatgccacaaaaggggagctcactgtacattctcaggccacatgaaattttcaagttattcatggtaaatcgtggttggttactctaagggaggaagaacttaagaaattaaaaagttaccttctaacttatcttaagatccataaacaattgaaaaataattcctggtctttacgaaatgaaaaaaaggggggaaaaagcattacatagatgattaataggatgaacaaaaagttctctgtagatttgaggctctgtctatgctgaacttggacttctaaagttcaaaatgaggaactgtttgctgaaatgtgtcatctgatttcaattgctgtggaaagggagagatgatctctaatatagccagctccaatctgtgtagggtgtttgggtcaaaatcaacatcttgagtttcattagggagcacttgcagtgagccttgcagatgtaatttgctacatccagccaacacctctgagcagatggatttctacactgtgcctaagagaggtttgttttttcttctttgaatgagttgcctgtgacttttataaaatattttgacagaaatggaatattgagatcatttataaattaaaactttgctgttgttggatttagtgagttttaatagaaactgatgtgaaaattatttagcatctatgaaaaacacaggggctgcttttctatgtaattcttgttcaccttagtggtttatatgtattgttctattttaggttttttaagtcatagttttataatcataatttccacttgttctgaaagatggtgatgtactgttacaattattttctttccagtttcacttagtgtgtttgactttaatcctcaaaccgtgtatgcaaataggattccttggggagaaaaggaagctcagaaactaacttccaatttgtttttgatgatgttgtttttaaataaatttgttgggaacaatcgtgtatgtattactagtaaaattaagctgttgcactacctaaatgtacttaatataattgctgtagacattattcttctctaagtagctcacattcagccttctttatcatttatttagttaagggttctatagcttttaaaggctgaaaaggaaacttaccctatttattccttgcttatcaattttgcatttcccaatctcctccctctccccaccacacttattttaaaaaccaaaccaatatggcagccctaatatgctgtcatatttttcctgatcacatttttagactatttttttaaagcagtttgagtttcatagcaaaattgagaggaggagacagaaatagttcatatatcccctgctcctaaacctgcgcagcctctccaattcagtacatttgttataactgatgaacctacagggatacgtaattgtcacccaaaatctgcagtttactagaggactcactctgggtgttttgcattctgtggacttggagaaatatataatgacatgtatctgtcatcgtagtatcatgcataatatttttactgcccccaaaaccttctgtgctcaacatactcatttctcagcccttgcaaacactgatattttccctgtctccatagctttgcctttttaagaatgtcatataattggcatcaaacagtatataactttttcatatgggattctttgacatagtaatatgcatttttgcttcttccatgtctttccatggcttgatagcttttatttttttgagacagggtctcattctgtcacccaggctagagtgtagtggcacaatcatagctcactgcagcctcaaactcctgttctcaagtaatcctcctgaggaggactatttgccacctcacctggctaaatttttttgtttttaaatttttgtagagacagggtcttgctgtgttgcaaagggtggtctctaactcctggtcttaggtgatcctcccaccttggcctcctaaaacactgggattacaggtgtgagcagctgcacctggctgatagctcatttctgttgtgctaatatttaattgtctggatgtactagagtttatccattcatgtgtaaataggcatcttggttgcttccaagtgttggcaattttaaataaagccgctatatacctccatctgcaggtttttgtgtgaacctatgtttttggcttctttcgataaatactaaggtacatgcatgactgccagatcgtatggtaaaaatgtttagttcggtaatataccaccagactgtcttcaaagtggccatacaattttgcattcccaccaacaatgagtgggaatccctgttgttccacatactcactagcatttggtgttctgaattttggccattctgataggtatgtagtggtatctaaatgctgtttaaatttagtttcctgatgacatgttctgtgaagcatctttttatacgcttatttgccatctgtatgtctttgattgaggggtctgttaaggtctttggcccatttttaaaaataggctttttaaattgttgagttttctttgtatattttggataacagtcccctatcagatgttttgtcagatattttctcccagttttgcttttctttttgttctcttgagtgtttttgtttgcagaaatttttaattttagtaaagtccagcttatcagttctttctttaatggatcaagcatttggtgttaggtgtaaaaagtcatcaaaaagtcagggttatctagatttcctcctgttatcttttaggagttttatagttttgtgttttgcattaggtcttgtattagtttgttcttgcattgctataaagaaatacctgagactgggtaatttataaagaaaagaggtttaatttgctcacagttctgcaggctgtacaggaagcgtggtggcatctgcttggcttctggggaggcctcaggaaacttacaattatggcagaagacaaagggagagccagcacttcacatggctggagcaagaggaagagagggagggttggggaggtttcacacacttaaacagccagctcttactgaagtataatttatataatgtaacattaaatttattaagatgtataaccatcatcataataaagttttagaacatttccattatcccaaaagttttcttgtgtccatttgtagttgatccctgctcctacctacagccctaggcaaccctgatctgctttctgtccctataaatttgccttttctggacattttaatacactggaatcatacaatatatagtcttttgcatctggcttctttcacttggtgtaacattttggtgttcttccatgatgtagcatatatcagtagtgttcctttttattgctgaggagcattccattgtatgattatgctacattttatcaattcaccagttgatatgtacttctactttttgcctacagtgaataatgctgttatgtacatttaggtacatgtatttgtatggacagatgttgtaactgatcattgatagagtctttagagtggaatttttgggttgaatggtaaatttatgttgaacagttcaagaaactcccaaatcactttctaagtggttataccgttttacattcttgtgatcgatttgttagggttagcgtagctgtgggtttttcagagatgcccatcatcattttgagaatgatccattttattcctagtttactgagaccttgaatttatttatttttttgaggcagagtctcactctgtctcccagactggagtgtagtggcacaatctcggctcactgcaacctctgcctcctgggttcaagtgattctcgtgcctcagcctcctgagtagctgggattacaggcgtgcaccactatgcccagctaatttttgtatttttattagagacagcgtttcaccatcttggccaggtttgttttgaactcctgacctcaagtgatctgcccaccttggcctcctcaagtgctgggattacaggtgtgagccaccgcaccagccattttattgaaaccttttaaaaaatcatgaattgcttgttgattttatgaaatagttttttgaatatattgacatcatgtggtttctatactttatgctgttactattgtgtattaaacaattctatataattcttatgtataattaataatcatgtgaacctagtatttctcaaatgtatcccatttggtcatagggtgttatcctctttatatggtgctggatatgatttgctaaatttttaaaggatttctgtatccatgcttattgaggggttttagtctgtagatttcttgtagtgactttgtctgcttttcatatcaagttaatgctagcctcaaagaatgagttgggaagtctttcattctgtcctgtttttgtaagtgtgtattagggattgacattctttccttaaatgtttgatacagtttaccagtgaagccatgtggaattggtagaacttttttgatggaaagtttttaaattaataatttaatttctttgttataggtctatacagattttcttccttctttagtcagttatggtaagttgtatctttcttttttttttttttcttttgagacagaatctcactctgtcgcccaggctggagtgcagtggtgtgatttcagctcactgcaatctctgcctcccgggttcaagccattctcccgcctcagcctcctgagtagccacgatcacaggcgcccaccaacatgcccggctaacatttttatttttagtagagttggggtttcaccttattgaccaggctggtcttgaactcctgactacagatggtccgcccgctttggcctccctaagtgctgggattacaggcatgagccactgcgcccagccagtaatttgtatctttctagacagttatgtattcatcttgagttatctaatttgttggcataaagctgttcttaacattcccttttaatctcttttatttttggtgagttaatagtgatattctctcattcctcattctggtaattgtgacttatcccttttttctgggttaagctaaaggattgtcagtttgataatctgttagaaataatttttaatttcgttgatttttttctatcttttttttcatttcattgatttcagctccaatctttactattttctttttttaatagctttgtgtttagttttatcttattatttctcatcttaacgctaaaacttagattattgatttgagaaatttattcctgtatgatgtgggcatttaatgctataaatgtctttttaaccactactgaagctgcatcccagaaattgtgatatgtttacattttttattttctttaaagtgttctgttattttccttatgatttcttctttgggccctgggttatttagaaatatgttgtttaacttccaaatattttacaatttcatagatttctttttgttgctgatttcttttttttatatatatactttaagttttagggtacatgtgcacaacgtgcaggtttgttacatatgtatacatgtgccatgttggtgtgctgcacccattaactggtcatttaacattagttatatctcccaatgctatcccccccccctccccccaaccccacaacaggccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctgcaaaggacatgaactcatcattttttatggctgcatagtattccatggtgtatatgtgccacattttcttaatccagtctatcgttgttggacatttcgtttggttccaagtctttgctattgcgaatagtgccgctataaacatacgtgtggcctgtgtctttatagcagcatgatttataatcctttgggtatatacccagtaatgggatggctgggtcaaatggtatttctagttcttgatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcacttctctgatggccagtgatgatgagcatgttttcatgtgtcttttggctgcataaatgtcttcttttgagaagtgtctgttcatatccttcgcccactttttgatggggttgtttgtttttttattgtaaatttgtttgagttcattgtagattctggatattagccctttgtcagatgagtagattgcaaaaattttctcccatgttgtaggttgcctgttcactctgatggtagtttcttttgcagtgcagaagctctttagtttaattagatcccatttgtcaattttggcttttgttgccattgcttttggtgttttagtcatgaagtccttgcccatgcccatgtcctgaatggtattgcctaggttttcttctagggtttttatggttttaggtctaacatttaagtccattgtggtcagataatatactttgtatgatggtcattcttttaaatttattaagactttttttaacgtctagcatatggtctgtttgggagattgttgcgtaggcacttgaacgtgtattctgcaattcttggctgcagcattctattaatatatatgccagttacgttgagttggttgataatcctgttcatttcttctatcaccttattgagtttctgtctaattattctatcaattatggagagcagggtattgaaatcttcaagtgttattttttagttgtctattttagcatttaaattctgtcagtttttggttcatgtacagtcatgagtcacttaacaatatgttctgagaaatgcatcattatgcaatttccttgttgtgcaaacatcatagaatatacatatacaaagctagataacatagcctactctacatttaggctatagcccatctgtggtataacatattgctcttaggctacaaacctgtacagaatggaactgtactgaatactgtaggcaattgtaagttttggtaagtattaattgttaataatggtaagtattttttattttatctcaaacatatctaaacatagaaaaggcacaatagaagtatggtattagaatcatatgggaccaccattgtgtatgcagtctgtcattaagtgaaacattgttatgtagctcatgatgtattttgagattctgttgttagatgtatatgtacctatagttgttaggttttactaaaaagttgaccctgtttattattatgcaatatctgtctctgtaatatttcttgtcttaaatcagtttttatctgttattaattatagctacttcagctttcttatggttgtggtttaatagtatacctttttccagctttttacgttaaacttacttttggttttgaatgaaagtgtttctagtttaaacagtattttgttaatcttgctatttaatgcagtctgacaatctctgatttttaaatggggcttttaacatttccatttagtgtaataataatatatttgaactcacttggtaatttgctatttgttgtctgttgttcctgtcttttttgttactctgttccccttttactactttatgtgctttatatctgtattttagtgtaccatttaattttctctattcatttttgtactatgtatattttcaatggtggctctcggagctgtattatgatttgaatttacattctacctcagttaagctcctaaattaattctggtaaattatggaaaatttgttctaatttatatctaatctttatcccccttattgacacatatatctacatataatataacccaatgttacagttacagtgttataattattgttgtatatattcagtagcattttcaagtacttaagagaagaaatgatgaatactatatctgtagagtctttcatataacccacatatttgtcatacccagtgctcttcatttctttctgtacattggagttaacacctgaaagattgcaggacaaggtatttctggtaaggaaggtctgccaccattgaataatctgagtgcctgtttacgagagaacatctttgtttcacttttagttttgaaggatagttttgctgggtataaaattattggttgactgttttgttttttttttcttccttggtagtgttatcagtttccactgatagtgttgctgagtgtggacattgttcaccactccaaatcaagtgacctctctttgatcatggcagcaatgccaccagtcctcatagttgtgctagtggaacctcctctgtggtagagatagaaatgacttcatgcaagaacatcacagattctcactcttcgtatcctaagttcaacagttcttcaagcataaatgcttttctcattctttcaatcccagagtgctgaaatggttgtgttttttgttaaatgttgtatcaactgtatctagctttgcagtttatttttggaaagaggattttaaaaaacctccttatttggccataactgcaagtctaacccaaatcctcttcttttctcaagctacttcatgtattactagtttttttttttaaatatttagcctggaaatgattgcatttcactatctccttagattggccccattacgagtaaggaaatgcaatgcattatgacctatgcagaaagaattactggtgactgctttatacttaagacaactgtgagtgtggtagacagtttgtgcaataaatagcacaaatgtatgattacatactctctcagattttcattttcatgaaatgaagttcagctttgaatcattccagctctttgacatctgagcttttcttcttacattcctgacaatatttaggaaaattacttgtgactttcattaatgatcttgcaagcttttctaacttatttaatgtctttgcattccttatagtagctagataaatttttttttaccgatttctttaaggttatctaattgttttccctacttaacaggcaacattcatattactttaatggaagtcagtgaaagcattgacaatttctcatccagacccatcacattcctaataaagagcctttgcaattctcctagaatgtttctcttccaaatagtcccacagctcactctctgaagaattacactttttcagaaaggccttactggagtatcctattttaaaatgacaccaccatcagctagtgtcccattactctgctaattgttctccagagcttttatcaacattgacataaactaaatatcagttaatagttggttatctttctttctaccactagaatgcaagctctatgaaaacaatgagtacgtattgctcagtgctctgtccctagatcctagaatgaggtcacataattttagctcagaatattggttcaacaaaagaatctgccttactagaagcaatctttatactgctgccaatgcttaagacccagccgtttttactcattcattcccctccctcccttccttccttcctttcttccttccttccttccaacttccttccttcctttcctaactctcccttcctccctccctttctccctccctccctccctccatctcttccttttgtgtactgtatgctatgcactgtgtttttagagaacttgcttataaactctttattttctccatggtggcatgtaagaatatcaagatatcttttcatcttgtccaatcaagataacaaactttttggttgtcaaatcgattagaactttttttttattcttgacatcattggttgattccttcttaaatacctttctaacttctggataaccactctcttttggttttctgtggatcttggccattctttctgaacgttcttcatgggctgtttttccctttcctctacctttctcttaaatacaggtattcttcctatgtacagctttcctaaactttagctatcatctttcactgatagtttacagatctctaagattttcacatacctgacttctttgttcctttcttatatgcccagatacccattttagctatacctatattaatgttaaggattgaatatttgtgttccctcaaattcatatgttgagcccttaacatccaatgtgatgtttatgaggtggggcatttaggaggtaattaggtttctgtgacatcatgaggttggagccagtgggattagtaccttaagatgaagaggaagaaataccagagcttcctctctcttggtcgtgtgagaacatggcaagaaggttatctaattgttttccagcctcaaagagtgttcttaccaggaaccagatctgccagcaccttgatactagaactcccagagctcttagagatggatgtctattgtttaagccactagtctatggtattgtgttataacagcctatgctgaccaagacagctatccattccatggcactgatgttaccgataggatcttgtcttatagagagtagtaggagtcttcaataccaatttaccctaagtcacacactgttataatattcacatttttagcaaaactatagggtaactactaatacctttgttgttggaagggcaatgctattcttttcagtcccttcttcttttaaaagcagtgattattctagttttgcattgtttacaattgaaataatgttttagagaatcttagagtattatatttctttatgaataatgaaatgttgacaaacaagtcacgattaatccagtagtgactttcagaagtaaataatagttttattagtaacatagatttctatatgtaaaatgtttttcacaaatttgaaatcaattatctcttaatactattatcattattattacattttgtacatgcagttcatttcacatttcctaacacaaaacagtattccaaatgtagaattttagttacagagcaaataaaactgaaggttgctcattttcatttcctttctttctatgcctttcaactgtcttcctcttctatgaagatggactagatatcatttataatgtcttgattttctttaaagtacctattacttaaattaacatcacttagaattaataaacactttatctttaactgtctattttattttattttaagatggagtttcgctcttgttgcccaggctggagtgcagtggcatgatctcggttcactggagcctccgcctcccgagtttaagcaattctcctgcctcagcctcccaagtagctgggattacaggcgtgcaccaccatgtctggctaatttttttgtatttttagtagagacagggtttctccatgttggtcaggctggtcttgaactctcgacctcaggtgatctgcccacttcggcctcccaaagtgttggtattacaagcatgagccaccgctccaggccttaactgtctttaaataagttaaatgctaactagtttggagtaataaacactctcagcaattttggcctatttatgtttgtagtacatctttctctcgagtgttatactcacaataggtggtagaatgttcctggttatactggttcatatttgaaatacagacctgcctgagtcatactggttttttgaatgtaagagaaaaaactgggagaagaggaaggcatttttgttgttgtttcttttgacaaacattcagtgactaaggtaatgaaaacaaagaaaactgaggaaagtatctccaatattgaccagcattctttccacatttgctaaatagatatttgtaaggtgattcaaactggcctcaagtacatacactttttcctgtagtgtagtagagtgttttttgaaaggaaaagactgattatctttccagaatattgattcctacccaaaaagattcagggtcataaattatatttctgtgataaggatttgtataaatagtcattgttcactaaccgcaacattgacaaaaacgttttttatatctatattattaaaattatttttgtgtcatgtaaaccataatcttttgattatagcatggtatgatatcagcaacatgtgatacaatataaagaaatcccctgtaattttctttttaagtttcactcatttgtaagtttaatatgttcctttggggacctcctccctgctccaccccttggcgttgacacatgtaacgcatagtctcactggttgttctttatttattcattttgtcccaaagctttctgtcatattcactttctttcacattatttggtctgaattacatcagtgtttggtcatcattttcttgagaattgttttgtttgtattcttttctctaatgataatatagaggggtaacaaattcacatacaaagagattctcaatcttcctgccttgttctttttttcttattctttagacattttgcttgaaaattttttaattctgccggcaatattttctctaaaatgaaagacttagattatagcattacaactttccaagtaaaataaaaatcttaatcttgaaggtcagcccagattgatagaaagctatatgaagttctcagaatagtatgtggttctggccagtcatggatgtctgaacatattttatggagtgcccagaacattattttgccagtattataagtagataaggtgttttcattctggtgtgtgtgtgtgaaaggaatacttgtgcagttaatgtgttttgtgaatttttctcacagtgggaaattgtggaatttttgtcattgcatgttaaaatttcatcttctaggtatagtgtgctttttaaaacaatctgtatgctaaataaatggacatgaagtgtagtaccttgaaaggttttttttttttttttaggagttagggtatgatatgctcaatttcaatttcctaatctgattccaaagaagacgcagaaatataactgtgatagtaccaatgttatttgggatttttaaaaatttaacaaattttaatctggtccccttccatccagcataaccaccatttagcatttcttggatacaataggatttgaaaaaatatatatagctcactaccagctttaaaatatataatccgaactcagtccaaaatattttaagacaaatttggcagagcctttattttttaaatagcatggaatttgatgtaggttttaaaataattttagaattagttacagatgatttagtttgtcattcttcctagggggaaaaatattttaaatcttaagacagacaaagtaccatagtgctgaccacatattattatgcagttatcattgtttccagtcaagttattgtgaactatgttgctaggtttattttattatgcaagtctcactttcaaagtttctaattttataataattttattaactatatttggtcaagacatttttaatgttcaaacttataagaatgtatcttctggtacctactgaatattgaatatatatttagactcctctaaaatatttgtagtatgatctacctagtaattcacttggtattttttcttcagtgaaaaaacaagggaagaccatgagtgcagtgtgatctctgatctcatctctgcctgggcacatccatcacccataggggaaaaaatatatatgaaggaaatataactaagtgttaatattatttattattgggggtggcaaaatagaaggtaaattatgaatggttttgatattttcttctttatatgtttcccaatttatctgcagtatggcatctattacctctctaattagaaaataaatgtcctcaatttgttctaaaataattgaattactaaaaatgatgttcgtgttatactctctgtactgacaagcactagtagaattgtaaagtccaaaatacaaatgatataaaattgatatcaccataataaatgtttaaaaatattctaatactaaatggactttttaagagttcaaaaattactttcctatatttacaagaaataaatggctttatctcaaatgtttatattaataaattaattttacctgagataagtcagtaaaagctcaaagtataaaaagggaattttgcttttaatcctgaaatttatgaatgccaattttttatcaagtgcattttatttaaaaataactcaaatgtaagaataatctagggaacatatcaaaattcatgctgggtcgtaccatcagagattttgattaagaaggtctaaagtcctaggaacctgtgttttaaaccagcatcccacatgaattctgaggcaggtgatccaacagaccatattagattgtttattcttttcctgtctcattccatggcaagatctatggtcattttcagtaccatagataaaatcaggattcaagttgaatctgttcctctacattctatcaggcagagctgccataacaaagtaccataaactgggtggcttaaagcaacagaaacatattgtctcaaagttcttggaggctacagtccaaaatcaaggtatcagatcacatttatgtaatgtgatctgttttctctggcctccagggtttgcatacgtccccaacagtttcacaatacaaccaactagggtaagggaagaagaagttagaacttttatttttatttttatcccatatatttaatttctgttaatgtacggtttatagtgtatataattactgacagaattttcagtagcatgtaaattgtttagcaccgtggtctcaggaatactatattcactttttatgatgcagtattagtcataaatgttaaatgttttacattttactatcaagtgaaaattaattgtctttttgtttgtgtgcttccctattcccttttatcccctatatcaggtgatgcttttccttggacgatcagcttgcataatttcagcatatatacccttcttggaaaacaagtgacactttgcctagtggaacctatgggttgcacctccactctagctgtcacgtctcaaaaactgcttgctacgggacctgatacacgacattcatttgttgtctgtctccatgttgacctagagtcactagagataaaatgctctaatccccaggttggtacatttgatttatgaaaggaaatttaaagtaatgtgatttaaaagcaattgttatccattttgttgaagggtttctcttctcttgagtatcctaaattatttttaacttggccatcaagatcagggtggttagattaagaattgctttgaagctctctcaagttgtgtaatttaaactcttctgaaaatgtaatggtggcagtacaaatgtatcttttggctgatggaatgaaatcagttgcagatgtaatgtttttaaacactgaagaactattttactgtaagactggaagagtctgttgaactgatcgagtgtaattttcattcagattctcactcagaacttctttgcttatcatgcaatttttttattattatactttaacttctaggatacatgtgcacaacgtgcagatttgtcacatatgtatacatgtgccttgttggcgtgctgcacccgttaactcatcatttacattaggtatatctcctaatgctatcccccgaccccccagcccacgacaggcctgagtgtgtgatgttccccaccctgtgtccaagtgttctcattgttcaattcccacctgtgagtgagaacatgcagtgtttggttttctgtccttgcaataatttgctcagaatgatggttagtctatttgagggtaaataaacaagggttaaattgtatgcaactaattatttgtgcaaacccaggtgatgtgaattcatattaaactgtaaaattacaagatacagcatgattggtctatgacacctgaaatctttttctttttaaaaatattatttttaaaaagaaatattaaaaaaaatttaaatattattttttaaaaacattatttgttatatttgttatattaattgttataagccaatttttaagagtacttttttaagtaggttcaagttagttgagcttgatggcacatgcctatagtcccagctactcaggaggctgaggcaggaggatccttgagcccagaagttagaggctgtagtgtgctatgattgcacccgggaatagccactgcactccagcctgggcaataaagcaagactctttctcttaaaattttttgttttgttttaattcactttttatgaagcagtattaatcataaatgttaaatgttttacattttactatcacgtgacaattaactgtatttttgtttgtgtgcttccctactccatttcctcccctatatcaagtgatacttctctttggactatcagcttgcattccatattttatagagcgtcttttttgaaaccatcctcatcctttcttttcttcttgcctccttctccctactatatactatactgtttgatttaacttttatatttgaaaagattagacctaataatatattggtaagagtcttattataaaaatgcatttaattggaattatgacaaggcagctttattaaaagaacactgtcataaaaacttaagaactcatcttccactacagtaaacattatttcatgttttctttctttcctttttttttttttttttttgacacagggtcttacttggtcccccaggctgaagtgcagtggtgcaatcacagctcatgcagcctcaaactcctaggttcaagcagtcatcccatttgaaccttctgagtagctgggactatagacacatgccaccatgaccagctaatttatttcatttttatttttttgtagaacagggtctcgctttgttgtctgggatgatcttgaactcctggcttcaagcgatccttctgcttcagcctctcaaagtgccgggattacatggtgtgagcaccatgccataaggtcatttattttagaatcagtagtgaatacttttgaatgacactaaatatttcagtttaatggctatttgcctttctattatacccatagtgatatagaagaaaataattatgaaatgactatcttctttgagattactctttgagtgctgctgctaatggttgctttaaagtgtttttaaaaggaaaggaaactgttatggattgaattgtgtccccgcaaaaatatatgttgaagttctaaccttgtgtatctcagatataaccttatttggttataggtttgtaacagaagtaagttaaaatgaagtcattagggtgacccaatgtgactggtatccttataaaatagaaaaatttggacatagacacatacaaagggaagatgatgtaaagatacacatggagattgtcatgtgaacatggaagcaaagattgaactagtggagctgtaagccaaggagcacccaagatggatagttcccaccagaagaagctaggcagagagccaaggaaggattgtactcagaatctcagaggttgcatggccctactgataccttgattttggactgtagcctccaagaactttgagacaatatgtttctgttgttttaagccaccgagtttatggtactttgttatggcggctctgcctgatagaatgtagaggaacagattcagcttctttagacactttatcacagaagttgttaaaaaggaaaacataagatatctcttagcatggcagtataagctccctcagcctatctttcctactgattattcctatatactctaggaaaaattcaaaaacaaacaattgactacccccacataaatgcatgttctcaacttgttttaaaataattgaattgcaaaatgactttaaggcagcttttagaaatttttatgaggtgcaaaggaaagcatactaaatgaaaaggcaataaatctcaattgaggaataaaaagtataaaaagagtcaaatggaattttagaactaaaaaatacagtacctgaaggaagaaaaccatattatgtgggcttaaaggtagcttggagatgatagaagaaagagttactaaacttgaacatagatcagtagaaattactgaatttgaaaaagaaaggaaaaaagtttttttaaaaagtgaacagagcttcaatgattgtagaatagaaaagtcgaatattgtgtactacttggagtttcagaaggagaggataaaaggattgggatagaaaaaaaaaaaagaggaaataactacagaaaactttgcaaatttggggaaagagatagtctttacgcatccaagaagttcacctaatcccaaacaggataaacccaaagtaacaaacatttggacacattgtgattaaaatattgaaaacgaaaaataaattttttaaaattttgacaattttgacagcagatataggaaaagacacattccatataagcaaataatgatttgaattagagtagatttctcattagaaaccacaggagacagaagacattggaacaatattttggaagtgctaacataaaagaactgttaacctagtgaagataccccacagaaatgaaagagaaataaacccatttttagatgaagaaaagctaagaaagtttgtcaccagctgctctattctacaagaaatgctaaaggaaattctgcaggatgaaggaaaatgatactggatgaaaaattagatctttaggaatgaaggaaaaccaacagaagggataaatggctgggtaaatatattttttaaaaaactacttaaaaatatgtgtgactcttgaaatcaaaaagcataacattgtctgctggttttttcagtgtatgtagatgtagcatacaagacaactatagcattaaggctagtggaagatggagtaaaagaatctatggttgccaagtttctacatatcatatgaagtggtacaatataaactcttaagtagaccgaaagttttggtgcatatgttttactctcttaggacaactaataagaaaatgcaaaaatacaaaaggataaagccaaaaagtcaatagagaaattaaaattaaatactaaaaaatattcaaagaagccaaaagaagatgggaaaaagtaacaaaggaacaaaaaatggagggtaaaacagtacaaaaaataaaatgctggagctaagccagctatattaataattacatgaaatatttatggtctcaattaggaatctgcaaactaatgcccataggccaaatttgcccacactccttttttacatattgtctatggtttctgccatgctacacctgcagaattgaataacggaacagtatggcccacaaagcctagagtatttactctctggcccttcacagagaaagttcacaaattattggtgaaacactccaagtaaaaggcaaagatctacagtgggaagtaaaacaagatgctaccgtataatacctaagattgtattttacttaaatataaagaaacgttataaatagatgcatagtaaaagatacaccatacaaacagtcagcataaaaaggctggacttacttattttaatcttagatagaacaaataaaaagtgtgttaccatagatagagtgacatgaaacaaaaattaacagaattaagggaaaaagatagagaattctagaatcgtagtaggaaatttttataacacctctttcagcaatggataaaacaactggattaaaaataaataattgaagatatagaagatatgaaaatactatgcactcaccttgatctaattggcatttatagaacagtatatccaacaaccgtagaatgtgcttttttacagatatacatggtctcatttttaagaggatcaaaaatcacatgaaagtattatttgaccacagtcaaattagaaattaataataataaaatagctagaaaaactttaaatatgtggacattaaacaacatgcttctaaataatttatggaacaaagacataattatttgggaaattagaaaatattgaatgacactaaaaaaaaactggataagctaaggcaatgtttagagggaaatataactttaaagacatattagaaaggaagaaagatcttaaatcagccatttaaggttcaattttagaaagctaagaaaagaacaagagaaacccaaagtaagtaaaaagaagaagataataaagatatgagcagagatgaatggaacagttaacaaaaaagtgagcaagagatagaaaattaataaactgattcttttaaaagatcaacaaaattgacagttccttagctagactgaaataatagagagggagaaaaaaatgcaaactactaatatcatgaataaaggggagttgataacattaaaagcataataagaaaataatgaacaactttatgccaacaaatgcaacaacttagatgaaatggaaattttcattggaaaagaattccatcaaagttgacacaagaagaaaagagcaaaaccaaatagctctatatcttttaagaaaattgaatgtgatgtcaaaaactttcccatggagaaaacttccaatctagatggatgaattctatcaaatattctggaaaaaataacataaatttttcacaaatgttttcccagaaatgaagcctgaagcatccctgcccaactggttttatgaagctagcataactctaataacaaaacttcaaaaagactttacaaaagaaggaaactaggtattaatatccctcatgaaaatgatatataagttcttaaccaaatgttaacaaatcaaagataacaatatctaaaaggcataatatatatattatacgtaatggccaactaggaattatcttaaaaatgcaagtttggtttaacattcaaaaatcattcaatataatttaccataataacaaaacaaaggagaaaaatcatatgatcatctcaataaattcaagtgagacatttgacagaattcaacatgcattcatgatgaaaagtctcagcaaattacaagtaggaggtaacattctcaaactgatagagatcatataagggaaaacaatggtaaatatcatacgtaatggtaaaatattgaattgtttcccactaagatcaggaaaaagtccaggatttctgctttcaattctattctgtatcatactagagttcctaaccattacaataaaccaagaagaattaataaaagatataaagataagaaatgaagaagtaaaactgtttgcatgtaacatattttatagaaaaccccaaaggagtctaataaactattactaaaactaacaaaactcaccaagcttttatgagacaaagttaatgtattaaaaccatttgtatttttatgtactagcagcaaacaaccggaaaatggaatgaaatcaacttcactctttactaacatccaagaaacataaatgaataaatctaacaaaagatatctaagacctctatcctgaaaaccataaagcgttgctgagaaaacttaacacctgaaagaagtaaagagatatatctcctcatagtttggaagactcaaattgttgatggcttattgatcttgatattgggcgtaatcaagtttaaaaaaatactttttgaatgacacattgagatagcagaaagcccgacatttggagaaggtgtttacaagacattcttcaaacaatggactgttatccaattttttttttttttttttttgtggagacagagtctccctctgttgcccagggtggagtgcagtgatgtgatctcggctcactgcaacctcctcctcgcaggttcaagcgattctcctgccttagcttcctgagtagctgggatcacaggtgtgtgccaccacacctggctaatttttgtatttttgtagagacagggtttcacctgttgaccaggctggtctcaaactcccaatttcaagcaatccacctgcctcggcctcccaaagtgctgggattacaggcatgagccactgcacccggactaaaaattttttctactcaataacatgaagatgaacaataaatgataaacataaagacaaataatggggaaaagacttgagcagatacttcacaaaatacttatttgaatagtcaataagcatatgaaaatatgcccaatatcattatcaggggaaaaacgtcatgaagaaatagaaatacacacctattagactggctaaaataaatgatagactcaatatgtggaccaactggaactcatcatacaccgcttgtgagaatgtaaaaatgatgtaacaacattggaaaccccttgacaatttctgaaaaagttcagcacacacttatcatacaacccagcgatttctccctatgtatttcctctgagaaacaaaaatatatatccacaaaaggtcttttacacagatgtatatagcagctttatttgtatagccccaaactggacacaactcacatgtttatcatcaggtgaattagtaaaaaaattatggcctactcataccaaggtaatactaatcagccattaaagggctgaattattgataaaatgcaaaatcattgacgaatcttgaaatcattatgctgactgaaagaagccaagtggaaaaagagttcttactccataattccatttacataaaatgttaaaatatgcagattactattaatatatagtgatagaaagtaggttacttgttgcctggaagtagaacagcgagagagaataaagagggggtgataggaagaggacatattacaaagggatatgaagatatttttggaagatacagaactgttgtttttctaaagtcatagtttatacttagtggtagctcagtctctctctaaagctacatataatagacagccccctgctacttggagttatctaccaaagttcttataatttaggaaagataattgtagctgtgagaggatagtcctactccacatgttctagttatccatagctgtcctagctaacacaaaaaatattcttagactccactattattcatatttttaaaattttctttactttgagatacttaatagttttgtgatttttatggtgttactaaatgtaatactttggctcaaaactagagtacttggtatattctctagctatccacattgtttggagctaagctcagattttgttgttgtttaaatgtaaaccagctctaagcaaagtcatcagctagatggggcttgtgtttggccttgtatttccttcctatgtctgttccttccctgttgtcctttcttcagttatctggcttccagagtcacctggttcccagtgccacctttctcctgttctcctgatgccaagaacctttttttctagaattactccaaggatgaatgaaccttatgcactgagagttcatttttactcgaaatgtagtaactcttatctctttatgtaattctactttataaatctcataaaatccttggagttactcaataaatcctcataaacaaaattgtgttaaactgtcaccacctggtgtaaccaacattgatcacaaggttgttgggaagtctgaaatatttatgaaaatattttgtaaacactgaaatgttatatgaatatcattttattagtgtagactgactctgattaaaatgtgagaccatctttgcaaattggtatgaacatccctggtgaaatgtagcaacattcctgaagagatgtgaaaccacaaaataacagcactgaagaatctatataaactaaaagacttggagagggattaatactctttgatatcttcaagtgagagattaacctaaattttaatgacaaaacatgagactctaaataaacctctttgttttgagtgattgctttagcttatgcttccagactctctttggatgctttcaaaattccaaaggatggcttgattttttttttttttttccatatgcagtaagcaaattcttattgagtgctacatgtaaggcagacatgaagatgaataaaacaaacacgcaaagaacgccatatctacatacctcataatccaactattgaaagccacaagtaaagaacaaatattgaatatatcacaagaaaatacatgtatgataccttacgttcaggggaaccaagatttgattaacagcttacttctcgtaagaaaccacgaaggccagaagaacatctttaaattaggaaaataaaaaataaaacgttgcaatcaatttagaagttcttaattaagcaaaaataacttttataaatgaaaactaaagaaaaacattttcagagaaaagactctatcaccagtaggaactgcatacaggaagtactaaggaacatttttcatgctgaaaggaaatgacaccagatggctgagcatctcttcaaatgtttattggccattgagtttgctcattcgtgaattgacagtttacattaatttatatttttctaattactaataagattgagcttttttcacatgtttattttccagtgaatttgctcttttgtgatttgttaattcatatcatttagccagtcttctattaaattcatttttcttagcaatttgtaaaagctttctttaggctctataaatacaaaccccataactgtaatgcagttcatttgcttttaaactttttgacatcttctgccagaaatttaatctttcatggtcaaagatacctatatattcctttttattttctgggtatcctgtcttaaaaggagtatcatggacccctaaaatgcacgcagacatacacatgacctaaaaatgtcttttactgttttttcttttaaaattaatgtctcagaatttctttcttgtgctttctcatttatccatctgtttttgttgtttgctttttgtttttaaaatatatttgttgtaaggaagaggagcaaatcaatacttcttgtcctttttataccattggctaaaagccgtgagccaattctcagaatattatatagacccattaagattgcatactgaggtatactgtcagaaggtttgtgagcttttgactgtagccagtgtgtacgtttcttgattacattttatggaaataattcctacttaaatacctttctttgacttatccattaggatgacatcagaattgtgacccttgtacactattgaatctatttcattgttgcctagatagagtaccttcatgtagttaatgtactttaaaaatagagaaggctatgtatgtaaggtaggctgagagcaaatttattactgtatcagacattactgtctgtctatgttattcctggaactttcattgccattcagtgttcttagacactgtgtatatttatctgggttgaatatttggtgctttcgtgactagaagagatttctgttatccattcccttcatcttaactatgtgaccaaagttaccctgtttcctttaatgtctttagacaccagtatctcagaccctaaatactatgcttattccaaagttaaatgagcctgtcctgtaatcccagcgacttggtaggctaaggtgggaggatcacttgagctcaggagtttgagaccacttgagcaacataacaacatgctgtctttatttaaaaaaaaaaaagaaaaaagaagcccatagaatcttttttttttttaatgtgatgaaacttctgtttacctttggccaacaaactgatacattgttttcttataggcattcacaggaacataacactttcttagcattttggggtttatatatgtggaactgagaaagaacagatttatgccagttttctattcatttatttatcgtttttattgctgttatgttgatcagtttgctgtataagaacacaggctttgagtttagacaaaactggatttgtatccttgcaccactcacccattttttatttctctgagctcttgattttttttttttttgagacagttgtttttttgttttgttttttttttttttttttgttttttgtttttttttttttgccgaggcaggtgtgcaatggtgtggtctcggctaactgcagcctccgcctcctgggttcaagcaattctcctgcctcagcctcccaagtagctgggattacaggcacccaccaccacacccggctaattttttgtatttttagtacagacggcgtttcaccatgttggccaggctggtgttgaactcctgacctcaggtgatccgcctgccttggcctcccaaagtgctgggattacaggcatgagccaccacacctggcgcgagctcttgatttttgttttaacttttaaacgaaattaaactggacaagtgtaatcttttatgtgaaaagttgtttttgtgtaaaaaaaaaaaaaaaacaagtttctgaaactgagttttaatgattagtaacaacctacatgccaaatgaaatagtttttctaagattgtattaacttagagctctctgcattgttcaacccagatcactaaattgattggtgaaattccgtttctccttgatttctgttgacattgtatatccatgttttttcttcttcctctctacctttagtgattctattctgacactatctcctgatactctgcaaaatgggcccttcctctctagccacctagggactcttcatcagccctgtatcttgtcttgatcatcccctgcgcttggcttttgttcattctgtatttctgagtagaatgactttgtactcatctaaatcctgtctctccttcaggaatataccttgaggcttttctcagcctctccagtgaaattgaatcttttttatgaacagctatagattaaatgaaaaaagtgtgtgaataaattttttaaacataatgttacatatttatattcagtcagcattcaatacacaagacattgttgatattcagacaccttcatacagaactcatgtaaagccacctcacatggtatttattttttagggatttttaaaaaatgttttattgaggtttacttaacatacaataaactgcatgtttaaattagctaatttgttaagatttggcatacatacacacatgaaactacgcccacaatctaacatcttcaagtttctttatgttcttatgcagtcctccctcccattcctccccatcacaggtaccattgtttctgtcattatagactaatttttgtttgtttttcttagcctagcttctttcattctgcataattattttcagattaattcacattgttgcatgcatcaatagtttatttctttttatggctaaacagcatcctgtcatgtgaatgtacttcaatttgttaactacctgtcaatgtatatttgggattttctccaatttttgcctattacaaataatgctgccatgaacatttgtgtacacatctttgtatggacataggcttcatttttcttaggaaactacttaggagtggaatagctggatcatatacggtaggtatatgctctttttaaaaactgtcaaatcgtattctaaattttacattcctaccagcagaaaatgagagcgttagttactctacatccttactaatacttgatgtagttaggctttttaattttagacattctaaacatgggaagtggtagttcattgtggctttacttggcatagtgttttagcacaacttgaaggataaaagttgaacatttatcctacatgtttttgccttatttctttaaacctctgaatttggaaagtctgagttctgttagcaactttcttctttgaaaataaaaatacgtttaaagtgtgtgtcatggtttgcatggcactttaaacacacagtgtactcgttgccattcaggcacagtattttctaacacttaaaggaatcagaagtagtgacaataaaagcagcatcatttctcttaaataaatacccttagaaatacttagaacctgttttggctttttgttattgttgtttgcactctctttatttatcagttctaattatttaagaaaaagcaaaataatctttttaaaaactggtttgcaacaaaattgtttctctatagagagaaacattcataattatgaaggacaaaagaatttgaacaaatatttttctaagacctttttaataagatttttagctactagattacttttaaacaaaaatagctgtaacctgagatttgaaacttcattacacaaaaaacaggagaaaattgtacacccaagtactgttttatatcaaatgaggattgacaatagtgtttttatgcatctgttctgcccacataagaagccagcttcatcatctggatgtgtcctggggctgaaactttttataaatacgagaatttcacttttttaaaatggcaagcagaatatggtgtccagctgtggatttgcttacatattgtgcttgcattttttcttcctgggcttgttttatacagtatatggcactacgttgtcatacaaatttcatgattaatgcttatttatgaaatcttgtgtaaatatcttaggactcagtcaaacaatgtgcaaattaaacagttttttctccgaatattggaatgacatctcctttgggaatagtaggttggatatgttctttatctattaaaaaaaagtctcatatgtaacatttgccttttactgttcaatgttatatcattctttttaaatttgttttgtgggacaagaaatccagtttcaagaaatcacagagaaaattagatgtggaaattaagatggtagttatttcatattatgctaaataattacatttactagaacgcctttgttttttaattttgattctgtcctctggttgagaggcatttgtatgtgttctattgttcacatattgaaatcaatctactgtttgctaataagctgtgcttacattactgtggttttaatccacaggaatgctaggttgatgaaaatatcacagagtgagtatgaagcaaatttcaagtgtaagttaaagtgatcagtgatgcattggtagagtttgttttataaattttatttctctggaatagttaattttctcatattattattttagtggattgaaactggaagttgaaagacttgttttcttttcttttttcttatgctctcaggtccagctcttctatgaactaactgatatcatgaataaggtctggaacaagattcagaagagaggcaatctcaacctatctccaacctctccagagaccatggcagggcctgttcctacttctccagttagaagcagtataggcacagctcctccagataccagcacatgcagcccatctgctgacattgggactactactgaggtaagtgtttttgaaaatcctgttacaaaatgaaggttaatatataacacagatttccagatcatggtttaaaatgaagataacctcactactgtgaaaactgatagattctgaaggttcaagaggagctgtggcagcagtgactgtctattccttttagctacaagaatttctgtttttaatcacttttagcagcttatggggtagttcaggatagtgcaggttctgtgaaatggtgaaaactgagacacagtaaaggtatgtttcctcggaagtatggaaatgtagaaactgagtgaaaaagagactcatgcttcccctttccctacctctgttccgctacaccttttttgaaccaggtgactattattatctagtcacctggtttagattagtggttttcaaccctatcagacccaatgccctctcctcttcctcccaattataaaagcttttctttttatttttaacgtcctaacctagcatgccagtacctcttttgtataagaaatattttataatgcctcctttactatcctgatatgaaaataaaaatataaccagaaatgaaaatgaaaaataatgtaacttacatatacatataatttcaaaaatatataatgtcttaaataaaaggaaagtaatttaagatacagtattatgtacttcaatatataaatgcctgggcatgactacattagaagacataacggaatagtcacatgcaattactgtgaatatgatggctgcaaatagacttgtacaggtctgtatttagtaccacaagtggtattgctgttggtgacatgattttctaaactagtgacaaactcttggtaaagtttcaaacacaacacagttcaatctttcattatagtagttgaattttggaacttctagtgtatattgaaatcatgcaaaaatgaagaaaaaagtgtttagatttgaaacattttataaacaggatttttatctatgtgaatatgtatgagacagtcttcatttttcaggactgccctattctacacaggatctcttgaacccctaactcctaacctttaaatcccaataatgatacacaaacattgagtcaacaaaaaatacccccattcatttccaaaacattgcttagagaacagaactttccccaacgagagcaactgttctatagtagatggaggtagaagttaacgtttttttgtttctgcataaagacaccatttcctctgggaataaagctattggcaaaatacagaatgggataagaatcaagtaaacgggatgttaatgtctttcatcttacaaatcagtaaaagcaaacaaactcagttaaaagggcaaatttcagctgctataaagcatttaacactttagagtacatctatttaaccccctgtacaagcaacttttctatcttgcccattccaaatcttaagaatcacagtaacctaggtgataagattattctttctcttttttcttttttcttcccaaatgaggaagcgataggaagtctagaaatgagcctgtatcaagttaatgggacgtatcgtttctagagtaaaagcagtgaattctttcttgaagagttccaatattattagcatacaaaatcttttagaattcctgcagtaaaaaaagctatttaactttattgaatacagcagtttccacacttacttaaccaaaagttcatctttctcagtctgcctattaacactttacaaaatatattttgtgaaatcctttggtagagtaatcaaagtttaaggtaatcagttgctagacaaagataatacaagtgaaaatgataaatacagttaaatcttagagacattttagtggctgaaaggagagtgttccattaaacagttgttttctaagtactgtgtgtacaggaatgtctagaaaaacatgacatccattttggagtgctcactcaactcttttggaaatgtgtttttttgaaagaaacatttaaaagacatttcaagtccaggaaagacagggctcacatgaaatggtgacagcttttggtcatacatctagagactgccgttcatacaaggtatagtgtgaatcctacactctagcattgtgcagtgtacaaacaacacaaaaggacatgatggccctgatgtgaaatgtaataaaaataaaataaaataaaaacatgccctacatttatagaggaaggattaataaattcattctaagaggtctgtggctattttgtggagaaaataatatttgagatgatggatatttaaaaatgagtaagacatgaataacaattttgttttactagatgtataataatacatactagaagaatagtatcttcatcagccaaagtgaagaagttaagaaaggggaaaattttgctaaattgcttaaaaagaattaattctgattttaataatacccttatatgactgaaattcatttcaaattagaaagttgaggattttttctgattgggttataaagacaagtaatgaaaatgctcatagtagatttgtttgttttgtactatctatagatttaatctgatctgtatcagatttgaaagatctgaaaatgacaaaattttcaaaatgtaccctcttctcttatttatatagtgtggtcaagaaaagaggtgattactactagtccaatatcaatttgaaatccacttaggaagattatttgctgagaagtaccttaaaacaatttagctgatttgtttttcataaagggcaggaagatttttatgaagatggttattcactattgaagctactgaatgaaaacaatgactatgttttcttatgtcatcatttactggctaattttgaaagaggtaaatttaaacccagatgcacacatagttaatcttaatctacctgtaaatattttttgagagcaagaatagaaattaaacatgaaatattcgatagacaaacacctccttataggttgcaaggtaaagttagatcaatgccttaaaattgatcatcatatcataaccatctgggtgacagagtgagactgtgtcctgtctcaaaaaaaaaaaaaaagagataatgcttgtaaaatacttagtttagtgagtactccaaaagggaaagctaatgtaaatctccttcataaaatttttgcattaggccttgagtacacgcaaatttctatatacacagggtaccatttaaacattttcaatttagtgagtcttcattttatgttcccagctcttgtaaagtcaggaacaacactaggatttactcacaacagagcaggcaagttgacagtcagtgatatgcttcatgtaacttgttaacagatttttgaaaccctactagggttaactaattatgtcatttcaattcaacttttaattttctccttagccctaggcagaagattctgccacactaatcaaatgcttgctgtaccatagtagccctatgctgttatttgttatatcattttgttataacaagagaggaaggagctataattataaaattatttcagtgtaacaatgttatttaaattcattaacaccttattaataaggcaataaaaaatattaagaacatatttatgaaagatgaattataactcagagcttgctaacgagtgcgctgaaacaccatgagatgtgtcacagctatgctgagacatggattaccttggcctttagagtctttggatgggactagggtgaatgaagctttcaatgctgtggagatttttctgcttaccacagatacaaataacatttcctacatatgcaatgatatgaaaaaggttgggaagtactactataactatccacaacacatatattctatatttaaatctgtatacagatagttatgttgttgacatgatagtgtggctaatagaaaatattcttataatcaacagattatcaggacaatgattattactaggaggagagaaggacttctagagctttccaggaatgctatgttcaaagaagcataaaggcttttgaatagattaaaacaaacaaaaaagtatttatatagtctcctcttcatattgttcattcttttatttcttaacattttaaaataattggtttatagtccttttagatttcttaactccatttattggagatgctaagtttttgttatatctgctgactctccctttttctggttcattttctcatgtggtttgtaatatcttattgtgaactcatcttcaacagtttaatttttctgtgtgattcctatgagccctctgttgcagaattgtccctacagagcattttgactgcttttgccagggtgctagagatttcagggaaccttgggcagtttttaggtttctttatcaacaagggtttgtcttatcatataagtagtatgcacgacgtcccacacaagcaaataatagcatttagtttctcatgtttgttttggtttttttttttactatagttgtccaggctggagtgcagtggcgcgatctcggctcagtgcaacctctgccttccagtttcaagcgattctcctgcctcagcctcctgagtagctgggattacaggcgcctgccaccactcctggctgatttttgtacttttactagagatggggtttcaccatgttggccaggctggtctggaactcctgacctcaggtgttctgcctcccaaagtgctgggattacaggcgtgagccatcctgcccaggcatgaatgattttatcatgccaccactttcacctcttctctgtcctaggaatctgaaaaacatccatggcatttcttagcctgctgaagcctagtgtctagtgtatcttttgcttaaaaagcagctctgtttgcctccaggctttatgcaaagaactccccagttcagactctacactatgtctgcagtccctgaatgagtgtttaaacaccattgctcaacccctcgacccttatctgagtttgatacttctacatactcccaaggactgtttccacttgttaccctgactttgtgtttcctcttcgtttctgacaccatagtatttgtctttatttcaagttttgctatcgtattagaaaaagatggtagtctgaaattggagtttatgagaatttagtaaaaggtcaaagatgttaactgggaagggaaatctcagttaacaggagatgattgagtatgctggagcagttggtgacaccagtaggcttaaagggcaggagagagagtttatcagaacagggaataaatacccagacttcattctccacttcctctgtctcctgccactgtttctcattgaccgaaaccaagaaaaaaaaaaaaaaaacagaggaccaggaaatccattcatattgttcacatagattaacttcccaagcacagagggtagtgaagggtagagagtagatctagagggccaaagaaaagatatgtagcacttttcggtattaaattcacctggcattttatccagaatatctgtgctgtggtagtacaaatggtaaatgttcatttcagcttagtctccatattgttagtattaaaatttcttactaagaactagtctttttaatctcactctccttgtacatattaacttctcaatcctatcaattaacttctttggtgatttttttaaattgtggtaaaaaaatatacatggtaaaatttaccattttaaccattttaaaatgtacaatttagtggcattaggcacactcacagtgcgtagcataaccactatctatttctagaaattttcatcatcccagacagaatctctatccccatcgaacaactctatcttctcctctccctccatccatggtaacctctattctactttctgtctctatcgatttgcctattctaggtacttcatataagaagaatcgtatggtatttgtccttttgtgtctggcttattctactttgtgtaatatatttaaggctcattcctttctttgtgtgtatcagaattccactcctttttatggctgagtaatatttcattgtatgtatataacacatttaatttatctgtttctttgttgctggacatctgggttatttctacccttttgtctgttgtggataatactgctttgaacactggtgcacaagggttgatgaatttttaatgaaatagttttgccttgaagtaattgtatgcatgttatatgacttgcacctgaaaaaccattttaaaactcatgtagtactagaaatagtatttaattttttaactgttgaatatgttgataactgatgtatttggtttaaaatgcagagggaggggaaagaaagtaaattgaagtatttttaaagatactttattcggtgctgattttctgatttagaagagcacatttctgtcatcttaatatcatttgcttagtactatcctgaatggtccagaattatagtagcacttaatattatcccttactgtgttcaagtatatttcaaaattttggcagaaaatatgggtcccaaagaggaaaaaagggaaaattcgagtagtctgtttagtttctatagtaacccttcaaacaaaaaaagaatgttagtaattgcttttctctaaggtgtatgttttttttttcctcctggggaaaactagctaaactgtctactactttcctactctttgttgttatgaagtctctcttttctccttttctcagtcttaacaattggcttcctctgactttggtgtaatagttttgtggaacttgataagtgagcaaagatctttgtcttaattctgtcaacttacagttgtattttcgaaaaagattgtcagacggatactttagaccagcatttttattttatatactagaaaattgaaacccagagaattaaaatttgtgttactgtgtagggactgggctgactgatattagcttgattctaagttagtggaacctctggaagagactttgtaaatttgtttaagttctttgtagattctggatataagccctttgtcagatgggtagattgcagaaattttctcccattctgtaggttgcctgttcactctgatgagagtttcttttgctgtgcagaagatctttagtttaattagatctcatttgtctattttggcttttgttgccattgcttttggtgttttagtcatgaagtctttgcccattcctatgtcctcaatggtattgcctaggttttcctctaggatttttatggttttaggtcttacatttaagtctttaatccatcttgagttactttctgtataaggtttaaggaagggatccagtttcagctttctacatatggctagccagttttcccagcactatttattaaatagggagtcctttccctgttacttgtttttgtcaggtttgtcaaagatcagattgttgtagatgtgtggtgttatttctgaggcctctgtgctgttccattggtctgtatctctgttttagtaccagtaccatgctgttttggttactgtagccttgtagtatagtttgaagtcaggtagcgtgatgccatctcctttgggttttttgttttgtttttttttttctgcttaggattgtcttggcaatgcgggctcttttttggttccatatgaactttaaagtagttttttccaatgctgtgaagaaagtcattggtagcttgatggggatggcattgaacttacaaattaccttgggcagtatggccattttcacgatattgattcttcctatccatgaatatagaacgcttttccatttgtttgtgtcctcttttattttgttgagcagtggtttgtagttctcattgaagaggtccttcccatcccttgtaagttgaattcctaggtattttattctctttgaagcaattgtgaatgggagttcactcatgatttggctctctgtttgtctgttattggtggataagaatgcttgtgatttttgcacattgattttgtatcctgagactttgccaaagttgcttatcagcttaaggagatttggggctgagacaatggggttttctaaatatacagtcatgtcatctgcaaacaaggacaatttgacttcctcttttcctgcttgaataccctttatttctttctcctgcctgattgccctggttggaacttccaacactatattgattaggagtggtgagagagggcatccttgtcttgtgccagttttcaaagggaatgcttccagtttttgcctgttcaatatgatattggctgtgggtttgtcataaatagctcttattttgagatagcttccatcaatacctagtttattgagagtttttagcatgaagggctgttgaattttgttgaaggccttttctgcatcttttgagatactcatgtggtttttgtcgttggttctgtttatgtgatggaatatgtttattgatttgcatatgttgaaccagccttgcatcccagggatgaagccaaagtgattgtggtggataagctttttggtgtgctgctggattcggtttgccagtattttattgatgattttcgcgttgatgttcatcagggatattggtctaaaattctctttctttgttgtgtctctgccaggctttggtatcaggctgatgctggccttataaaatgagttagggaggattccctcttcttctattgattggaatagtttcagaaggaatggaaccaggtcctctttgtacctctggtagaattcggctgtgtatccatctggtcctggactttttttggttggtaggctattaatttttgcctcaatttcagagcctgttattggtctattcagagattcgacttcttcctggtttagtcttgggagggtgtatatgtccaagaacttatccattccttctagattttctaatttatttgcatagaggtgtttataatattctctgatggtagtttgtatttctctgggatcggtggtgatatcccctttattattttttattgtgtctatttgattcttctctcttttcttctttattagtcttgctagtggtctatctactctgttgatcttttcaaaaaacgagctcttggattcactgattttttgaagggttttttgtgtctctatctccttcagttctgctctttgatcttagttatttcttgtcttctgctacattttgaatttgtttgctgttgcttctctagttcttttcattttgattttagggtgtcgattttagatctttcctgctttctcttgtgggcatttagtgctataaatttccctctacacacggctttaaatgtgtcctagagattctggtactttgtgttttcgttcttactggtttcaaagaacatctttatttctgccttcatttcgttatttacctagtagtcattcacgagcaggttgttcagtttccatgtagttgtgtggttttgagctgagacatccgctgttagtctgatgggcttccctttgtgggtaacctgatctttctgtctggctgcccttaacattttttccttcatttcaaccttggtgaatctgacaattacgtgtcttggggttgttcttctcaaggagtatctttgtggtgttctctccatttcctggatttgaatgttggcctgctttgctagactggggaagttctcctggataatatcctgaagagtattttctaacttgattccattttccccatacctttcaggttcaccaatcaaacatagatttggtcttttcacatagtcctatatttcttggaggctttgttcctttcttttcactcttttttctcttatcttgtcttctcactttatttcattaatttgatcttcaatcactgatatcctttcttccacttgattgaaacgactattgaagcttgtgcatgcatcacgtagttctcgtgctgtggttttcagctccatcaggtcatttaaggtcttgtctacactgtttattctagttagccattcatctaaccatttttcaaggtttttagcttccttgcgatgggttcgaacatgctcgttttgctcggagaagtttgttattaccgaccttctgaagcctacttctgtcaattcgtcaaagtcattctccatccagttttgttccattgctggcgaggacctgcaattcttggaggagaagaggcgctctggtttttggaattttcagcttttctgctctggtttctcccctctttgtggttctatctacctttgttctttgatgttggtgacctacagatggggttttggtgtggatgtccttcttgttgatgttgatgctattcctttctgtttgttagttttccttccagcagtcaggctcctcagctgcaggtctgttggaatttacaggagttctactccagaccctgtttgcctgggtatcaactgcaaatattgcagaacagcaaatattgctgcctgattcttcctctggaagcttcatcccagaggggcatccgcctgtatgaggtgtctgtcggcccctactgggaggtgtctcttggtcaggctacacgggcgtcagggacccacttgaagaggcagtctgtccgttctcagagcttgaatgacatgctgagagaaccaccactctctttagagctgtcagacagggacgtttaagcctgcagaagttgtctgctgccttttgttcagtatgccctgcccacagaggtggagtctagagaggcagtaggtctagctgagttgcggtgggctctgcccagtttgagcttccctgtcacttagtttacttactgaagcctcagcaatggtggacacccctctccccgccaggctcctgcctcgcaggttgatctcagactgctgcgctagcagtgagcaagcctccctgggagtgggacccatggagccaggcacagggtggaatcccctcgtctgctggttgctaagactgtgggagaagtgcagtatttgggcgagagtgtaccgttcctccaggtacagtctgtcatggcttcctttggcaggaaagggaaatcccccaaccccttgcgcttaccaggtgaggagacaccccagcatgctttggctcaccctccatgggctgcacccactctccaaccagtcccaatgagaagaatcaggtacctcaattggaaatgcagaaatcacccatcttctgcgtcgatctcactgggagctgtaggctagagctgttcctattctgtcatcttggaagcgacttcgaaattattatatacgtaatttatctcctttattctcttaatgtgactaattatatcgattgattttcacatgttcaactgaccatgcatttctagaaaaatcccagtttagttgtgatagatattgctagattgaggttgctaattgtttaggattttggtatctatagtcatgagtgatactgaccatttttaccattttaagtatataattctgttgaattctatatttttttcttataatagccttgtcatcttttggtattagattagaagtttatactctctttataaatgagttagcaagtgttccctcttgtcctactctctagaaaactgttttcatttgaaatttctcctaatcactgtatatttccatgttaaaaaagtaatcttaattgaaaaggtacttggctataacacatatctgatctaaatttgaaagtcttagtttagatgtcatttagaaaattatttgaagagagagagaatgggttgggcgtggtggctcacacctgtcgtctgagcactttgggaggccgaggcaggcagatcagctgagatcaggagttcgagatcatcctggccaacatggcaaaaccccttctgtactccaaatacaaaacttaactgggtgtggtggcgtgtgcctgtaatcccgattcgggaggctgcaacaggagaatcacttgaacctgggaggcggaggttgcagtgagctgagatcgtgccactgtactccagcctgggcgacagagcaagactctatctaaaaaaaaaaaaaaaaaaaaagaaaagaaaaagaaaaagaaagaaagagaatgaaatggtaaggaccatatggacaaaggaccctaatttaataattttaaagagaacacagagaagcatcttgatcctttttccatctccaacactgatatagctttgttcctagaaattaaacttcatactatgtattgataaaataatacttaatgataagataaatatttctatcccactccagtggcccaatttatgtcaagtaaaactaatgaacatatagatgctaaacacatgtaatgtgtttttgttactgtacaatcatgattttatattactataagttttttggcttaatttttttgttgtggtacaatatacacaacataaaatgtactgtttttaccattttatgtatacagttctgtggtattaagtacattcacattgttatacaaccttcacaacagtctccagtattttttcatcttccccaactgaaattctgtatccgttaaaaaataactcaccatcttaatattaaatcttccaatgtatgaacactggatgtctttccatttatttgtgtcatcttaattttttttaaagatatttcatagttttcattatgtcttttacttcctcagttatgtttattcttaagcattttattattttagatgctattgtaaagggaattattctgttaatttctttattgtttgcttttaatgcatagaaacacaactgatttgtgtatgttggtgttgtatcccacaactttgtggaattcattgattagttctaaaagttttcttggaatctttagttttatacatatatgatcatgtcatgtgctaaaagacataattttactttttcctttccaatttggttgccttttatttcattttgtctcctaatttctctggtgaggactttagtagtttttgaataaattttccaatttattttgaaaatattagacaatattttgaagtttaccataattatctctttttataattttcttctcaagggaaacctctaacattcttttggctgtaagtaaattctgtacagatagccaaagacatattgacaaactggccctttattgcttttactttttccatgttagttgtactttttatactgttttttttttctatcttaaatatttgttaagtcaaacactatagattacaaataaaatgattcagactgggagacttccactgacacagaagtaaagatgtcaaatagtgattatattgtttcagtgccatactggatgtgaaatataaactttccatcaccattcatcactcattatctttattaaaggataaccccaatttatcttaagtatggttcaaagtaggttctaaacatagtcttcttcataatatagatgttgaataattttggaatactaactcacattatgattaatttaaatcacatttattgtggtacatggcatagacatgcatatgttcattaagtcactacacatatttttatgtaaatacgtaaaactatatttacaatatgagtttgtattttcagtttgttttttgtccttaatcattttaaacataattattttcttttattttttatcagatctggtatctgaacttctttagagttgaatctgaccacttgttgttttcttaaatcttgttcatgttggattgttttctttggcactgtgtaatttagtgttgggtgattctcatcaatggaacttcttctatgaagcccttacatggtggttgagggcctgtcctctgacaaagacattttatgtgtttgcttctctaagggacttcagcagctgcctctagcctgggacccctatactgttaatcttacagctagaagttttttgaaacatttaggcagtatgaaatcaagtccttaaacctacttgcactttagagttgtttttaaaaattttctggggtaactttgttgccctacttaggctgagatagatattgcttttttattgggtttattctgttgttttttgaatttcttaaattttattcttagcttattaatattcagtattttctttaaaattgattgatgaaaaggcggttgaggcgtctggtgagtagtgcatggctaggaatagccctgtggtgatttggaggatcaggcaggcaaacctaagttattaagacatagtcctttatcatttgaggaatttataatattagtgatggggcatggatgtgcgtataaacataattccaaagtgggctgggaaatttagcccatagttggattaccgttactcacagacaactttgtattatagaagggagagcaaaatttgggaatacagccacctgtttctgccacactcactgttgcattggttttaaagataaataaaactttatattttatgaagaacatactgcactgtacttcagctaggtgaagttgtcaaatttttgttgaggtcagtggtctagaaagtggaacattatataattatactcattaaaatttttatgctattttgcttataggacaatacaacaataaaaactgccattaaaagcactaacattagactgggcatgttggctcacgcctgtaatcccagcactttgggaggctgaggcgggtagatcacgaggtcaggagatcgagaccatcctggctaacacagtgaaaccccgtttctactaaaaatataaaaacttacccaggcgtggtggcaggcacctgtagtcccagctacttcggaggctgaggcaggagaatggcgtgaacccgggaggcggagcttgcagtgagccaagatctcgccactgcactccaccctgggcgacacagcaagactccatctcaggaaaaaaaaaagcactaacattttgatgattcctcttcatgacaagtaaacaaagcaaacacatacatacgtacacaagtacacacacatccttcccttacaggatactttcataacctgtatgtctttgggaaactgttataacaacataaaatcatattttggatctctgggttttcagtagtttcaataaatgtgattttaaaggattatattctgttgacaaaattaaattcctctgagttgtgattttaggcaaattatttagtgtttttttcattttaactttttctgtgtatataaaatgtttttggtaacgtcttccttaatcacagcagtagtataggaagtaatttcaaagctgtagaataatctaaaattctgagtgaatactagaatatttatttacaaataatttatttgtaatatatataaatatatatatttatgtaatataaaaatatatttatatatttcatatataaatatatatatttatgtaatataaaaatatatttatatatttaatatataaatacatgtatttatatatttaatatatataaatacatgtatttatatatacatatatgtatgtatttatgtatcatatatgtatatatttatatatacataaaaatgcatatatacataaaataatatgtatatatttatatacacataaaatacatatatacataaaataatatgtatatattttatatttaaatataaaaatatatttatgtaatataaaaaattattacaaatatttactctacctaaagtaagaattgatatattaactactcaatgtttggaagcttagggtcatggcaaagtgtgacaagcattgtttattgattcaagaattaaaattgctttattatcagcgttgttaaaaaaattaagcatgaagtggttccttttttaatgtccagtaactgttgaacatacattgataattgaaaagtgaatattggactgagagattgtttggcatcaacttcagagttgttgacagagtttgctgtagtagcaaaactcttgtcagtttttcagttattcaagtgcaattaacctatgcagtaatctacctcaaattattatgcaaacaaccgtttagatagtatatttagtttgaatttactcaattgctatttttaaaatttcttgtaattgttttaaaactcctgaaaatacttatgtcatttcatatttttccttaaatggttttgttcttaacatttagagagaaacttttattcagaatgtagaaatcataacatttaaactatcatcttatttgaatatctatgaaaaaaataaatatatcaaaacaggttagaaaaatgaaggttattgtttagccatcacataccattcaacacaatattttgtgtatgaagcctttcctatttcaaaatattcatataaaaatgtctttaaattattggctacttgatttttaaaagctcagatagttttatcatgtaaatataagctaataatctgaggttagcttacatttcttgtgttacttgtattaattatgtatctggggaacactttgaaattgcaggtttgatttttttaaattacaatttgcattcaaaaacaatcattaaaatttttaaacattttactattaaaacattgtttttcttgcttagttgggtcaaaactattgaatatagagaacttactgtaaatgaatctagtttaagaaaacacattctagggaaagcattaggagatatacctaatgtaaatgatgagttaatgagttaatgggtgcagcacaccaacatggcacatgtatacatatgtaacaaacctgcatgttgtgcacaagtaccctagaacttaaagtataataataaaaaaaacaataaaaaagaaaataagctcatgaaaataaaaaaaagaaaacacattctaacaattgtttgtattaaatggaaatatttgtttatatgatccttagatgatttatactttaaactatgagtaattcttttcatgctgacatgttgatggggagcactgtacttttgtgcacatatagctgcagcttcctgtgtttcagtctgagtcatggtaaagtgggaaatatgagtttgaagcttaagtactgagcttaaaacacttaatcattttttcccactcttgcattgaaatagtgggagcaaaggtagttgagaccacagcaggccacttgttactgttgacttaagtacaaacagtggtcgaagtgtttagccctttgggaagttttgtaattgaacaagaatgcaggagttattttgataagatagagtagcaatggggccaaaactatgatcatccttaagctctgaagcaggccaaggatgaagggatataaagtgtttgctcttccaaataaacaaagataaattcacctaggaaaataaacttagcatttggtcaatttgcaacaaaatggtaaaagaattgaactgtttattttagaacttggcctaaggatgtatgggaaaatagttcagcatctccatttccggcctgattttcacaacagatttggaaacagagcagaaaattaatgcacaaacatgtttaacaataccaaacaaaatgctgtaaatccaaaatgaaaactgaaactgcatgaggaagtacagcaaagcttttactgaggagtgcttactaaatttgcagccacagttttcttagcattcttaccaagtataccaagtagtgttaaaaattgaagtcttagtgattcgagatgttattttctctcagttctccatccttggaatatgatattcttctgtctgttggaaggagggtttaatttaagcatacttctactctataaacctatacataaagaaaggctatatatattgccttttatttaataagcatccttatctggaattagtttatgctttttattagatgttgtgttgcattagacagctaaccaaaaacctgatttttttatagcttctcaagttgtaggaatttctattgtagcagatttagaactacttattttgtaaaagcatttatatgaaaactgcacaaacagtgagatatttgctttgcttggtgtatttgggacaaagagtaactatactgtcttcaggtttaactctataattttctctaatagtaaatcccagaacactgttactttgctatgcttggtgcctaagtgttcttgcagtaaacacttgcctgtcattctatgaaaatcttccccattgggcctccttctgaggttgcagggaaattgaattttcttctgactgaaagatgttataaaacaatgaggttaaaataaaagcctcatgtaggagctgaatatacctgtgtttagatggcatgtctgtggtaatgagagccgggactttggtttgttttgtacaggattttaattatcattcctgcttttaagtgtttagagattagtggcttctgctctgacaacctgtctataaaaaatggaatactgaccatattatattgtctttgtttaaattttaaggggtattttgttctgacagttaactactggttatgactcgttagcacaggaaattaatatttttgtttgagacattcaaagcaataaactattggaggttgaggatatacggcaaaacaaaacgtgtctgaagttagaaagatgagaaaatgagaattctataagaatgtgagtgaaaaatttcttaagcattagttcaacttgataatgataattataactacaatttatgaactattttctatgtgtatattcttcattcacattcatatttctatttaatcttaactgtatgagataaatatcactataataaccattttacagaggagtgtacagttaaactacttgcctcaaatcacttgactggcatctgacttcgttaacccagtacaccatactgcctgccagactaagcttaactaagtatctgtaactgatatgtaaatatatatacatcttttaaacaaataagaatgttatattgtgtttgatcagttttcagagtatatgggtttaagctcgcaagttttgtttgcaaggtttaaacggacagcaaagtttgggattttaggaacccaatacttcatagctaatcctaaaagaactcaacatatcaatgattgcagcatctcttctgcatttgagactgaagctgttcaactttaaataaaagggtttattttattctggcctgctaaaagctgctgaaaagaccaaaaacaaacaaacaagactttgacagcaagttcgttagcactgactttaggaccttatacatattcagagttcagtatgtatttgttgaatcggataagcttatgctctattccactaagaaagctttaaccatataagacacttaaaaaaatctattgtcaaatctactaatttttaatgtctccttaattaacatgcaaggcatgattaatattttgctgtttcttaaactgataatcactttgctatagttattctagattccattataaatactctatagaaggggtagacaaatatttttctgtaaagggctggttagtaaatacctttggactttgtggattgtagcttctctgtagcaactactcaactctgctgaaaagaagtcatatgcagtcagtacatgaacggatttggctgtgatctagtaaaaatttattccccaatacagacagattagccccttcactgtagcttgcagactctactctataggaacatactcattggtttaatcttaaccttttctagatcttaactacttttagaggaagctggaaacatgcatgtgctttctaacaataaaaatcatttgagaagtgtatgtttatacattagcattatgtattggtattaacatttatatgattatcatttgcatgtaagatgtgaaaaagttacaaataataatttctgattttaatttataatttgtattttctgttatttttgtttatgttacaaagtaagatttttttttctcctcatcccagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacaggtacaggattccttttctttcttccctccctccctctgtccctccctccctccctccctccctccctcccttccttccttcctttcttttctgtctgtctgtctgtctgtctgtctttccgtctgtctgtctgtctttcctttctgacagagttttgctcttgttgcccaggctgaagtgcactggcgtgaccttgcctcactgcaacctcttccttctgggttcaagtgattctcctgcctcagcctcccgaatagctgagattacaggcgtgcaccacgacacccagctaattttgtatttttagtagagacagggtttctccatgttggtgaggctggtcttgaactcctgacctcaggtggtccgcccacgttggccgcccaaagtgttgggattacaggcatgagccaccatgcccggcctggattgcttttcttctttactgaaaagtgcaaatattaaacgctattttggaagaaatattaaatgtaatttattattgtcatttataattaaataattattattagctctaattcaagtaatttctagttgcagtgctaaaatgttgaatcttattaacattaaaggtttacgtgtacatattttccttgactttgtaatacataaattttgtcctgtttgtattaaaattcatctaaaagaccatgaggaattttcctcaatggtcatattgatacattatagtattgtcactaaaagtattgggaaaatccttgactgatatcaaatataacactccagacattaactgggctttcccctttcttgaaataaatgtcttatcttaataaacaggcctatgctgatttgcttattattctagaagcttttgtgatctcagcgcctctgtacatatccagcatgcatttgtcaatgtgaaatgtaaaatagaaagttttaatattaattgtgaagactgtgttgatattactgcttgtttcttattgcagaggtttgtatggtcagtgaactagaagatctcagtgcttccatagatgtccaggatgtatataccaaagtgaaatgtaaaatagagagtttcaatattgatcactatagaagcaggtaaataatgaataatgaatataagaaaatctgtatttttctttgaacaaagttaccataagactttttctattttaatttggctggttattaaaataaatactatacaggcatacctcggacatattgagagtttggctccagactattccaataaagtgaatatttcaataaaggaagtgacagaaattgtttggtttctcagtgtatataaagttgtgtttacactatactgcagtctgtgaagtgtacaatagcattatgtattttaaaatgtacataccttaatttaaaaatactttattgctaaaatgtgctaatgatcatctgagcattcaatgagtcataatcttgttgctgatggaaggtcttgtcttgatgttgatggctgctgactgatcggggtggtggttgctgaaggttagggtagctgtggcaatttttaaaaataagtcaatgatgtcatttgccacatggattgaatctttctttatgaaagatttctctgtagcatgtgatgctgtttagtggcattttacccacaacagaacttctttcaaaattagagtcagtcctctcaaactttgctgctgctgtaaaaaatgagattatggaatattctgaatcctttgttgtcatttcaacaatgttcccagcatcttccccaggagtattttgcatctccagaaaccactttctttgctcattcataagaagcaactcctcatccattcaagtttcatcatgagattatagcaattcagccccatctttaggctccactcctaattcttggtctcacattgttttcaccacatctaccattacttcctccagtgaggtcttgaaaccctgaaagtcacccatcggggctggaatcaacttcttacaaacatctgttaatgttgatatttttacctcctcccatgaatcatgaatgttcttaatggtgtctacagtggtgaatcttttacagaaggtgtttccatttactttgcctagaaccttcggaagaatcactatctgatacagtttggatatatgtcccttccaaatctcatgtggaaatgtgatccccagtgttggaggttgggcctagtgggagatatttgggtcataggggaggatctctcatgaatggcttggtgcctccccatggtgacaagtgaagctcttgatttcttagttcatgcaagagctggttatttaaaaagagcatagcatctccctgctctctcttgcttactctcttaccatgtgacacacctgttctgctttgccttcttccatgagtaaaagcttcccaaggcctcaccagaagccaagtagatgatagtgccatgcttgtacagcctgcagaaccacgagccaaataaacctctttcctttataaattacccagtctcaggtattcctttatagcaatgcaaaatggactaacacactgtagccttacagaatgtatttcttaagtaataagtcttgaaagacagaattactgcttgatccatgagctgaagagtggatgttagcagatgtgaagacaacattcatctccttgtatatctccattggaactcttcagtgaccaggtgcattgtcaatgagctactgctcatttacaaaggattttttttttctacacaagcagtcgttctcaacaaagagcttaaaatattcaggagaccatgctgtaaacagatgtgctatcatccaagcttagttgttcccatgtatagagcacaggagaagagtagatttaacaaaattcttaagggccctaggattttcagaatggtaaatgagcattatcttcaacttcaccagctgcattcacctttaacaagagagtcagcctgtcctttgaagctttaaacccaggcattgacttctcctctctagctatcagtctgagatggcatcttcttccaagagaaggctgttttgtctacactgaaaatctattagtgtagccaccttcatcagtgaactgagctacatcttttgtataacttgctgccacttatccttcagcacttgttgcttcatgttgcacattaatgttatagagatgccttctttccttaagcctcctgaactaacttctgctagcttcaaacttaacttctgcagctttcttacttctctcaatttatagaattgaagagagttagggtcttgctctggatttaacagaatggtgtgtctggtttgatcctctacccagaccactcagactttctgcctatcagcaataaggctgtttcactttcttgtcatttgcaagttctctggagcagcactttcaattttcttcaagaaccttccttttcattcacaacttggcacaagaagctttgttttctgcctatctcagcttttgatatgccttcctcactaagcttaatcatttttagatttttatttaaagtgagagatttgcaactcttctttcactggaacacttaggggccattgtagggttattaattggcttcatttcaatattgttatgtttcagggaataggaagacctgaggtgagggagaaagatgggaaatagtggggtcagtggagcaatcagaaaacacacagcaatgatcaattaagtttgtgtcttcaggacatcactgttcatgatgtcctgaaataattatgataatgtcaaaaatcactgatcacagatcaccataacagatataataataatgaaaaagtttgaaatattataagaattaccaatatgtgacacagagactggaagtcagcatatattgttggaaaaaacgctgctgatggatttactcaatgtaaggctgccacagaccttcaatttgggtaaaacataatatctgcactatgcaataaagcaaagcccataaaaccgaggtatgcctgtacttattctcaaagagggttcttaacagatacattgattaattttacttagtaattgttcatgtatggagtataataaaattttgttttataagatgacaaatctgttcataaatatatacattgccatattaaatgaaataagctacttttactaataatcttacataatttattttctatattttatatttgttaagatgcctgcaacccagttgatggctctgatttttgctgtatacgtcccatccattctctataccaatataatcattggtatagagatatacaatacaatcattggtatagagatataatcactgagatggagcaatagctcatttcctaagcactttgatgactctcatctcacagatgattattatgtatatggatatgataattatttttgtcatattaaacagtgacttattaattggcttttgataatagaatgttcaactctttagttcctttgaaatggtatgtgtctgtatcaaaatgatctttgcaagtgataatacaatattttggctgaagtaatttttaatgtcatgaatattacgtattatgttgtactttatccctgactgtaccgctaaatttatataaattatagatattcagataatttattaatttattaaaaacatacatttcttgtgtatgtggtatgcaccaagtgctatgctaaatgagtactggggatgtagtgtttaagaaaaatagcctggcatggtggctcacacctgtgatcccagcactttgggaggccaaggcagggggattacttgagcccaggagtttgagaccagctgggacaagatggcaagaccccatcaccacatacacacaaaaaggagctgggcatggtggtgtatgcctgtagttccagctgctggggaggctaaggtgggtggattgcttgagcccaggagttcaaggttacagtgagctatgattgtgccattgcactccagcctgggcgacagagcaaggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaattgttctattgattgcattgtcagatttatgttttagttcagtgcagtgttgtgaactttagacttatttgaaatagttatgtatgttcaatttcttaactcagaaaaattgaagagaacagataaggtgaacttatgttttccaggccaggggaaggttggcagtcaggacattttgaaggagtatttctacaatgcaaagaaaaatctgtggtgagacccatttagttactatgatttttgaaaatgtactttaaactgtttatcttgttatttcataaaataggactaatggttacaagaatttgagttcagaataaattcttattagcctgtttcttcaaaattacatataaatttaaagctatttattctttgaaactgctcctgttttgtaaccatcttcctgttataacaattaagtaaatttatcaaagaggcaaaggtaggcttgcttttgttaatatactttatctttaatgtactattgtgttgactttttggaattgtttcccaattcttatgtgagtttatgctggattgttctttaccataaactggaagtagtaattttatactaaaagcaattattttttgtttactttcattaacattgcttttgcagaagatggtccaggcagaggccatacctagcggttgctcaaacctaaatttatacaaacttgaggagaatttaaaactatccagatatttttttgcttatggcttttattgctttttgtcttttcaccttctttgctcctgtccatcacttcaagccttggggaagagtgttggtctttggggcaatgtggaggtgtcttcctttcctgtactgacaagctgaacagacgcaccttgttggttcgacccatcagcaagcaggaccctttcagtaattgctctggcttctttccttctgtaagaaattactttaaattatgctacacaactcccattaacaggaacccagagaaggaattgaatgattcatagagtcaactcttgatttgtgttttcctccatatcataaactttataaatgaagtataatgtaatttaaaatcataaaactgcttttccactaaaacctgtttctgggtcacttgcatgagtacagactaattttacctcaatataaggaaatcaaagtaggacattcattatatttttttaaattgtgcatgtattgaatgatcaagagttgaccaatactgcttttgtcattcctcttacgattcttaataagattgcctttaaaaattttttttctattattatgccattgttttcttacaactaattcaaagtaacttgtgtggtaccttcttgaatctgaacaagtttgcatttctgtcattgattaggtagatgaacacaaggctgtatcagtgacttttagacgtttagaaccttgacttttttaatggtacaacatctggatatgttcttaagctaattcttttaactgatattcttaaagttaactttgttcttaaatttaatttttaatagtgtatttgcatagcaagtgttatgttctgattttattttgagcttttactagcaatagtctttaatctttagtgcaggaaaaaaatgtgacttttgtgttggaggaagtgtttagatttattttcctctctttgaatgttcattagtgtctgtgaaaaacattcttaataattttaacaaatattcataaagaaaccgtaaatttatcgttaatgttcttcagaaattttttctaaatttataaattaaatgccatttaaaaagtttctttacttagtgttttttaacattttattttaaatagtataaagtattattactgtatgaaaaaatgatatttatattacctcaactagtattcactttttgccttatgttaagggagttaaggatgcagcaattaaaaaaaaaacaccctttcttcatgtggcttacctttcaagtatgcttacattccacgtttaaaatatttttccaaattaaaacatttatacattgaaataccttttatactctttacaggattcaaatgttgctattaataaagatttattatgagttagatttttttagattagtggtcagtagtaaccctctccccagtttagacacttagaacagacaacatcactgtgatcactgtggcctcttccactgggggtataccttaacaatccttctccatctgttattgctcattgtccagcaacatgctaataaaactggtagcacttttcttgctttactatacatctttttgtttttgagtgcagaaataaaaaagaaggggaatcaaaagagaaacagtgaaaatgttgggaacagtgaaaaatgctttgagagcaggctattattgggaaagatgattatactgcacaaccatttaatgcttactttccagggtttttttaatggtcaattaaaaaatacaaaaataatttattttcttatcttccttcattataaagtctaaattaaaagcaaaattagcagtgataactgaattgcatattttttcctctcaccatgtcagtgggtgataggcaacaaaatgagaggaagaaaatggaagcaattgaaatgtaggagtgatgggataatatagctcagactcattactgctttcctatttctcttttttttctgtttatgtgaatatattttcttctttttgctttgttccagttcacttctcctcttaaaaatctcctctttggaccctactaactttttcaggtgttggaaagaggggcagggaatgtggaatataacagttctcctctaattctatgctgagcaatttccaaaacaatattttatgtctattaattggttgaggaagatttttttcaagtgacattctttttgtacgttgaggaatacaaaagtatatgttttactttactcttttaaaagcatgctgttttactctaacttgtttatagtgtgcaatttggataggagagctaattgagatagttttaacaaaaatattgaagttatgataatttttttactctgttaaatgttatatgtgtactaatatagtagtatacccaaagattatgatttacaggatagtgataattagattttataaaaaatgcgttagctattgataataggcaagttctgaaagacaaatgttatattgttacatcacattactgtttaaatatgcagtaactgtttatttagttcagttatcaaagcatggtatcgatgaggcttcttttgtaggctctgtctttgtataaattagccaaattattgaaggaaaaactccattttcacaaatgttatatcctatctagtgaaggtaatcatctggcctattcagatttggtctcaaataaaaatatgtaatgtggttatttcaatttcacctgagtaaacaacccttctgtgacctgtgatactttttatgacagcctcttagtactcataatgaaaaattatcacgaaatgaaaagataaaatcaagatagtcttttccaacctatgtttttttgtttgagacagagcctcactttgttgcccaggttggagagccgtggctcaatctcggctcactgcagcctctgcctcccgggttgaagcgattcttgtgcctcagcctcccaagcaactgggattataggcatgtactaccatgccaccacatctggctaattttttgtattttgagtagagacgggatttcaccatgttggccaggctggtctcaaactcctggcctcaagttatctgcccaccttagcctcccaaagtgttgggattacaggcatgagctaccccagcctcaaattcttaatgttacagaaaatgcagaagtcacagaaatagccacaaaaagattaataacctccctcaagatctagaactggaactcaggattcccatctttagttcagtcattctaaccatcttagaagctttttgcccacatctgcagaattgatcagtcatgtgtttattaagaagtgtagggtaagaccaagaggtaaaaatactcactgaggtcattttcttctttccaatttttaaaaaaaatctttttaatgaactgtgtattgtgatttcctttttttggaacagacaactacaaaacttctagatggcactcatcagcagcatggattcctctctctgacatacacaaaagctgtaacaaaaaatgtccgccacaagttaacatcaagaaatgagcgaagaagttttcataagttatctgaaggcctaatggatggttctcctcattttcttcatgaaattcttctttcagcacaagcttttgatattgttctttattttcctttacttaatgccattgcaagtatatttcaagcaaaactaccaaagacccaaaaagagaaaagaaaatctcctggtcagcccatgaggacccatacactgacatcccgcaatttacctttgatttatgtcaacacaagtgtaatcagaatttttattccaaaaacagaagaaatgcagccaactgttgaaggtattgtcttctgattttttttgtctgattttaaataattttcttctagagaccttagttttctgggtttttttgtttcttttaaaaaatatgagcagttggttgtgctttgtggtttggtatattttatagagaggaaatatagatattctacaaatcattaggaaatacatcagaatactatgtaactatctgacttcgttagtaggataagaaattgaggaaattttttcttcagggcttttgccagtaaagcatatatatactttgtgttaattgttttactaaactcaaatgttgtgttctgtgtatctaagagaactaaaattttttttaaaaacaaggtcaagcacagtggctcacatctgtaatcctaacactttgggaagccaagataggaggaccactggagcccaggagtttcagaccagcctgggcaacatagtgagaccccatctgtacagaaataagatattagcccaacatggtggtgcacacctgtagccccagcttcttagcatatcatttttgtaataaaatatttgtatacgaaccttatagtgcttaattaccaagctagaactaaattcaatgtattatacttaacagattcttaatacaagccagtttctactttttatgtctaacttttcttagaagctatcttaaaattaattactttgagatgtgaaattactattctctgaatatcctatattctgacagtggtatacagttgctttcatctgttcagatagtttgtagaaacacatgaatggttaagaataaagagttagtctttatttaccaattacaagtgataaacaactcgctaaccagaaaagtaagaagcagtatattcattgcaaaggtaatgacctttatgctttttccttattatataggagcacctaatgaaattttagagaatgtaatttacattaagtttacataggttagaaaacagaaatctacgtttttatacagataattccctgaggactgtagtttcagttataataacatttttccacaaccttggaagagacacagacataaaagattggggagattgtcaaactgtttttggcattacaactgagaatgggaggaaaacaccatggaaacaaaagtagattgtctttattacacaaaatttatcagtgttttgggagaagaatttggggtaggtcattacatttaataaagaccatgggctgggcacggtggctcacgcctgtaatcccaacactttgggaggccgagtcgggcagatcatgaggtcaggagtttgagaccagcctggccaacatggtgaaaccccagctctactaaaaatacaaaaaattagccaggcgtggtggcacgtgcctgtaatcccagctacttgggaggctgaggtgggataattgcttgaacccaggaggtgtaggttgcagtgagccaagatagtgccattgcactccagcttgggtgacagagcaagacgccatctcaagtgggaaaaaaaaaaaaaaaaccataatgttgcagtatctgtaactattttattaaaataaaattacagaagttttatatctagataaaaataagaataaagttttatactatataatataaaaaattctaggtatagtttttatacaaggatattgttttccacaaatacctctctgattgttataaaacattcatttttctaacttgagttcctgtatttcatttaaaatatgttagtaggcttttatgatttcctgaatatttcctgaagtgtttgttttatgttccccattccttaattgtaaaattattttcagtttaatgcaaacaattaggaaggccaaaatttcattgaaacataagaaaaaatgtgatattagaggtgagagggtgggatgaggtatagaaaaatacagggagaatctctatgaaaaaagctgaggaaatagtgagaggctatagagacagaaaaggaagtaaagcaacttatctaattggtagacttttttactaataaagaaatgttgacgatttataaatgattctcaaattttatgatgtaattgtgtctgaataataattgtataatggacactaaatttagtcatttatcacatattattccctacactgttttaatttagggtttccttcttgaaaacccatttcacaccacaaaatatcaatttcagtaacaaatttaaattttagaagacgaaccaaatgtgtatgattcattgcctatttattaagttttaaaacttgaccaagaatatgatacaatatcagtgtgttgtttttttctgcatctttggcagccaggctgagacttttaaaatgggtatctaataatgtatacactggtaaatctttctgagtcagacatagcggctcctcaatgtgggcatttgatctgtattcaaaatttgctcatttgtcttaaaatatcttatctatctgatgtcctgaaagcttctgaaagtctttggtatttgttagtgaggaatattttcacaataaattgctttttcattgcaattagatcttcattgcagagcttctttgactcaaatttttgtggcaatacctgtgagagaaacctacatgactgacttgttttcaccatccatgtcagtgttcgtcatagcccttaggtgttcttcactggataggtcttatttatagtgataaatgtttccttctaaggcaaaatttgcctataaatgtaaatagttttcattgttaatttggaaaccttgttttttctcttttttattgtggtaaaatatatataacaaattttctactttaatcattttaagtatataattcagtggcaataattacattcataatgttgtgcaaccatcaccactatttccaaatgtatttgtcaccccaaacaaaagctctgtagccattaagtaatagctaccttcatcttctggtaacctctaatctattttctgtctgtatgaattttactactctagaaatttcatgtaagtggaatcatacaatgtttatccttttgtgtctgtcttactttacttagcataatgttttcaaggctcatccaagttgctgcatgtatcagaacttcattccttgctatagctgaataatattgttttgtatggatataccacattttgtttattaattaatctgttgggcagttgggtcatttccacccttttttggtttaatgtgagtaatgctgctatgaacactggcatggaagtttctgttagaggccctgttttcagtttttttggggtgtacacctaagagtggaatttttaggtcccgtggtaattctgtttggaattctgtttttgaggaaccaccaaacttcttggaagcccttgtggattagagcacgatttgtggtattttctgaacaatgccaatgtgcaggcatagttcagtcaacaagaagagcaaagggagctcacgcttagcatagcagcacctgtgtgccgagcacctgagcagctctgtggtgaggcagaggtctgaagttcattgtttaactctagctttattttctgtgatacttaccaatggtttattgaaacaagttatgtttcactgatatgtttgtgacaaaaagattacaaatcaggctatttaagaaagaagaggaaaaaaaagaacaactttattttctgtggggcttttttagtttgtttatatgtttttgttttgggcttattgtgttataaacattaatactacatatcacacagttttattgtttcccattgagttgcttcaactaggaaaatccctcaactaattgtaattgcagaaatatttccagacttctgccatcttatttttaaagctgctgctgctgctgctgctgctgctgctgcttctgcttcctcctcctcctcctcctcctcctcctgctgctgctgctgctgctttttcttctttttttggtggtggctgtggtgggtttttaacatataatttcagaattcaggtgcctaggtacttcctaaggtcaccttgaataagagtatgtgagattggggaaggtttttatagttgtctttggaaaacataatttcttttgtttttctgtggactttaagtggaatcctttgcaaatatgcatatttttagcaacaaacaactttttagtggtgtttttttttgtggcttggatgtatgtatctgtagaataaattaccagcaaaaggattgctaggtcaaaggattccatacctttaaaatagtaagcgatgtctaattgccttcctaaatggctgctatttcttactcttaccctaacagaagtttatttttagccttttgtacaaaggtctcattagtgaaaagtacgctactttttaaggagttgcttatcttttccttattaattaatacattttttgtgtattaatccttctgtctggcatatgtattgctcatatctttacttttttgtgttcagcctttgcatctctgtatctgtgcatgtatctgtatctttacttataattgtacttgcatctctatctgaggtgttataaatagccagactgtgtgcctaagctaagaatgcaaatacaaaaatgcatgccaaagtttcagattttgacacattatgttagtattttttatactttatctttcttctttgctactcttaatttaaataatcataattcacccatgaaaaggtcagaaaacaaatttttattgaggtaaaattcatataacaaattcaccattttaaagtgtagataattcttacattatattttatatgggagattggatgtgtccatttaatacatgttaaaagctataatgtggactgtggaaatcatgattgaaggagcaatttcattagaaataaatgtcattaatgactctagtaagttggagtcaagagtatactattcattttattttagaaagcctttacaagaaagtttgaataagatgattatcagattaattaaattaaaaatgtaggccaggcatggtggctcatgcctgtaataccagcactttgggaggccaaagcaggcatatagcttgagcctaggagtttgagactagcctgggctacatggcgaaaccccatcctacaaaaaatacacaaattttctgggcatggtggcccgggcttgtagtcccagctactcaggaggctgaggtgggagaattaattgagtccaggaggtcagggcttcagtgagttgtggtcacaccaccaaactccagcctgggtgacaggaggagaccgtgtctcaaaaaaaaaaaaaaaaaaaaaaaaaaaaaaagtatatgtaagttgttttaataagtgtgaaagaataactaaatcttgctacatcatacttttcagcagaaactttattataaaaatatcacagagcaatctgtgcttgtcacagagtaagtaatctgtgtcaaagatgagtggtaaaccaaatgcaactaaactttctattaatatgcataatggtcattgattatatgtttattgaaacgtttgtcttcaactgccagtatggcaataactgattaaaaacttttgttgaaagctgtcacaacagttttggctttatgaaagcataacattaaacagtggcaacttcaaatactcttgagacttcagatgttttactaaattgagtttattttgagaatcttaaaggaaagttgaagtctccaaaacacttttattcaggttggaattaagaaaagtttgttgtaagcaacattcttatattatctgacagttgcatgaaaattctggtctttattcaagctattggttactgatacaaactcctgatttcagagttgtttatagccttttcatatgccatacacaaatgtacattcatgcatctgtacacacacgtatacacactctcttgccccaagaaaagatgaaatctttcaggcttataatatacgctacattaatgtaagactctttaatcatatctaaatttcagttaatgataaaaaaattgaacattctactattttatttagaaaaatgatattgaaagtctgcttttcaacctggatattatttacattatgtgcagttactatcaggattctaaatctacaagtctttgacttccagcttaatctttttatttcacaatagatgacttttaaaaatctagcatgtctagaatgagtagttcctcatgaggctcaattttaaaaaatagagttaaagcaaggaaggaaggcattcattttcatgttgaaaatatttctagaaggaacatttcctcatatggtccaactattaaatacaggtgaaataacccaaaaaagagaagctgatttttttttgcggtgataaagtaactgaagaaatgactcaaggcactttcatgtataaatacatatttttattatttttttttacatctcggtgatatattttgataagttgaatactttctataataaaattaattattttaatctagtttatgaatgatctgcattaagtgctcttttttttaattataacttcatagtcagtataatctactgagaacacttttggccctaacagaaacagaattctgttcttggatctggctttgtatgtaacaccaagtacgtcatttctcctccatatttacctcatttactgcaatgtttctattacatttcagactttcatatggtgagtagtatctgtagcctggaagaacagttagcaaatatactaattgcacctttgtggtacggtttattctccaggcttactacgtaattgaggactgctgcttaatcagaggttttacccacatggaactatttgataaggttggcataaaatgcaagacctgtaaaatgtaaacaatgttcatattataaggacccataatcaaaccaaacctctaagtcatttgaaaatagtgcagctgcatgagaagtagttttctatttgatcttttgctatggatgtaaaaatactgtctttactgtgacatccgtatgctaatatttgttatgatagttcatctctttttttctccttttgctgtcccttctcccaccttcctactattttgcctttccctcctcccttcatggttatcttattctggttccttatttctctcactgaatatcttattcttcttatgtttttctgattttcttaattctgacgttctttccttggactaatctgaattagaccataccaagtatgtgaaaatatactgaaatatactgaatatactgaaaacaatacactgaaataatatactggaaatacagctggaaataatctcgtagcttttgcattctttgggcaccacagtttgggaaatatggattgtatgcctttgtaggcaggttctgttcaggatatttcttaggtcttgcagccagtcattttctgttctatttttggcagatggtagttccttgagagaaattataagttttaatatacgtttattttaagacctagaaagttgtatattgttaacattttttaaacagggtttatacagctactatagtagaatcatctgttggagaatagagagtaaaatgtaaatgtatttttttcatgtgtctgttggctgcataaatgtcttcttttgagaagtgtctgttcatatccttcacccactttttgatggggttgtttttttcttgtaaatttgtttgagttcttcatcactggccatcagagaaatgcaaatcaaaactgcaatgagataccatctcacaccagttagaatggtgatcattaaaaagtcaggaaacaacaggtgctggagaggatgtggagaaataggaacacttttacactgttggcgggactgtaaactagttctaccattgtggaagtcagtgtggcaattcctcagggatctagaactagaaataccatttgacccagccgtcccattactggggatgtacccaaaggattataaattatgctgctataaagacacatgcacatgtatgtttgttgcggcactattcacaatagcaaagacttggaaccaacccaaatgtccatcattgatagactggattaagaaaatgtgacacatatataccatggaagactatgcagccataaaaaatgatgagttcacgtcctttgtagggacatggatgaagctggaaaccatcattctcagcaaactatcgcaagacaaaaaaccaaacaccacatgttctcactcgtaggtgggaattgaacaatgagaacacatggacacaggaaggggaacatcatacaccggggcctgttgtggggtggggggagggtggatggatagcattaggagatatacctaatgtaaatgacaagttaatgggtgcagcacatcaacatggcacatgtatacatatgtaacaaacctgcatgttgtgcacatgtaccctagaacttaaagtataataaaaaaatgtaaatgtaatgaatggggccattaatttcccctttcatgccaaatagtccttagaaaagacattgaattcactgttgagttgtggaaaaagtgctgaacttcagccctaaatgagagcatacagtcaaatatcattttatttagtacaaaaaagagaattagaactgatacatccttttacctttttttgttttctgggattatttatcatagttttagacgtcattaggaggtagaacttttaaaggggtctggggttccaatttctaaagcaattttacagtagaagttattaaaattaaaaagtatctagaataacaggttgatatgttctcccatattgaatagttggtgttttccatcttcaacattgcagccatcatatttcttttgaattttctgacattttggagcttaaagtgatatactttgtgtgtgtgtgtgtgtgtgtgtgtgtgtgtgtgtgtgtgttgtatttaattattatttagcatgtaaatttaaattgctttgagaatttgtcactgactttgtaatatccttcaatatatttgtagacaacaatgaagtattaagaacccaaagctgaaaagcatttaggagaaatatgcagattgtgaagttagataaacatttggcttcaatattacttatatatatttaatatcataatttttaatgttgggagtggagttgtttttcttttctttgctattttaattgtgtattttaacaggaaaccacttaatgggtattaacagagttaagaaaagcatcaaagatttttattttaaacatgattttttttcattttactttttcttatttattggtcttatcttaatgtgtctctattccattccctcaaagatttctccttatgcataaagttatgtacagatccacagtgtattcatgaatctccttcttttgttacagctaatcaggcagcaaaagaagacactgtggttttgaagattggctctgttgccatggctccccaggctgacaatccccttggcagatctgtccttaggaaagatatttaccagtaagtttattttcttatgtccaatcttgcaacaattttcatcctgcaaacacatatagtggtcaataacttagtgtggcctgtagaaatatttctcattcaggatcttttgatatttaaaaccaggtttttctgattttcttcagttgtgggttttttaattcattcagacaaatcaagtatttctgtgaagtgttgatgaataacagaatgtaagtactaagtcaccataaaactgaagaagcatagtttggaaaattttagcagatgtcaaatttgaccaaatctctaatcacataagaaaacgaggtcctctgtagaaccaccacatcctactgtagtcatgttgtatcaaagtgaaacattttattaatttaagtgtaagctattatttgaaatgtaggaatgtggatgtcatatggatcaaagctataaagaaaagcaaacttctaaagagaaatttcacagtaaacactttctgtgaaaatgctatgctctggattttgtcactgagtatttgcaaaccacaccaagcatacatggacaactaaactggtgaacatatgtaatcaacatgataaaaataatatatgattcatactgaagttggcactgctgccagacagaaaagtacagttgcaaataataccaagtgagaaaagtcacagaaatacagatgaacaagtgatttattcttcttgctggtctgtttttcagatgttgtagtctcactcttctaaaaaataaattcctactgttctccagtaaatgttactgctaggaaaagattctaattttggtgattcatttaccatctagagggtgatggctatttttactttaaatagatctaggaactttatttctcatatttctctgatatttgagttataatttcttcctttgacttatgtatgtatgatctcttccttgtattttttttaggtatttaatagtattcaccccttaaataagtttttatgcagctagcttatatataatcttaggatttcagagcagaaagcgtctttaggaattatctaactcaacttccctgttttacagattaggaaactgaataaccaaaagaatactgtagttgtccctggtgaaagagtaacagagccaagattataattcatatcttttgactcccttaggatctagggaaatgattataatagaacataaattctatatgagaatactttaattttctaacatttggaaattctttcaggtgtctttatcttttctacttcagaagtaagtggtcctaaaatagagacctactttacttttggtgaaagaaatctaggttatattaagagatcctatcaccatcagtaaagtgaaccactgagataattcctttccttctgtaccctttccgctttctggcttttgcatgagttgtatttttactttctgggaacaattgtgtgaaattgtttttttagggtttccttctgtctgtcttgcaactttttttcagtcatctttactggtcttcctcttaaacaatctctttgctattagtatttcttagggtcttccttttattctttttttttgcccaactcttcttgggtgaggctctctgctcttttggctcaggacaacttgaattctaagcatgtagggtaacttggggtgaccctgtagaccaaggttagcaatatgtgttagaatgtcaaatgtaaaattctagatgctggatggcaaactcaacctaataatttttctttgaaagctcacattcaagtcatttctacataaacaaactaacaaaaggtattcatataagagtttatcaaaaatgtatcaagatctcagtgaaatgctgtatcatcgatatcaaaggagtaacagcagaattagaaaccacttttgagtgaatgatcagagtgggagtagctcagtataataaatgtatacacaaagcaaaagaccctgcatactagggctgattttattattcctatgattttgttaaccatgaaatctcagtgaactagatgcaaaagtccacatattatgtgattccatttatttgaaacgtccagaatagacaaactcagagagacagaaagtatattagtggttgccagggcctgcttgtggaaaggggagggaagagtgggaaaggactttgtcttgcggcttgggtgccagctcatcctcaatagaacagagcaccaagtagattcctaaggtttctgactccaggccctggctcctggacagcatctctggatgcatttgggagccggggaactcaccactctgaagggaaggacacaagcctggttggcttttctatctgctgattgctgagccctagggccttgagtgaacacaggccatagccaggcagtggttaccacgggcattgggtgggacccagtgctgtgctggcttcaagtctgacccagcgcagtcccaatggtggtggcagccacagtgcttgtgtcacacacacacccacaccccttccacagctccagacagctcagcacaggctgtgtttgtttgggagaaagtaagggaagagagcaagagtctttgcctggtaattcagacaattcttcgggatcttatccaagactaccaaggtggcacctgtacaagtctgcaagagccacagtgttactgggcttgggttactccctaatgcagatatggcggcaatgaccaaaaacttagatcacaacacccaagcttcttcaaataactggaattctttccctagaaaaatgggtacaaacaagcccagaccacaaaagctacagtaaatacttaactcttaaatgcccagacatcgatgaacattcataagcatcaaaaccattgaggaaaacatgagctcaccaaacaaactaaataaggcaccagggaccaatcctggatagacagagatatgtgacctttcagacagagaattcaaaataaccattttgaggaaattgaaagaaattcaaaataatagagaaggaattcagaattgtatcagataaatttaacgaagagattgaaatcatttaaaagaatcaagtagaaattcaggagctgaaaaatacaattaacatactgaatgcatcagagtctcttaacagcaaaattgatcaagcagaagaaagaattagtaagcttgaagacagactatttgaaaatacacaatcagaggagacaaaagaaagaatgaagtacacctacaaggtctataaaatggcctgaaaagggcatagctaagagttattggccttaaagacaggcagagagagtgataggagtagaaagttcattcaaagggttataatagcaaagaacttcttaaacctagagaaagatatcaattcaagtacaaggttgtagaatacaaagcagatataacccaaggaagactacctcaaggcatttaatcatcaaactcccaaaggtcaaggataaaaaaggatcctaaaagaagcaagcaaaagaaacaaataacatacaatggagccaggtacagtggcttgtgcctgggatcccaaccctttggaaagctttacgtgggaggattgcttgagcccgggagttcgagaccagcataggcaacatgatgagacttcgtctctataaaaaaacttaaaacttagtcaggtgtggtggcacacgcctgtagtcccactgttctgcaatctgagatggaagaatcacttgagcacaggaggttgaggctgtagtgagctgtggttatacccccacgctccagcctgggggacagagagagaccctatctccaaaaacaaacaaaaaccatacaactgagctccagtatgtctggcagcagacttttcagtggaaatcttacagtccaggagtgacatgacatacttaaagtgctgaaggaaaaacagttgtaccctagaattgtatacgcagtgagaatatccttcatacatgttgtagcagaaatgaaggttttctcaaacaaaagctaaaggatttcatcaacatgagacctgtcctacaagaaatgctaaaggtagttcttcaatctgaaagaaaaagacattaatgagcaatgagaaattatctgaaggtacagaactcactggtaatagtaagtacacagaaaaactcagaatattataatactataattgtggtatgtgaactactcatatattgagtagagagactaaaagatgaactgattaaaaataatacttagacagtacaataagatataaatagaaacaacaaaaagttaaaaagcaggaggagaaagttcaagcacagagtttttattttctctttgcctgtttgtttgtttatgcaatcagtgttgtcataagtttaaaataatggtgtatattaaatttgaaaaacagaaaactcctagggcacatggtactattctttgaatacgtagctgataatgtgtcatagggagtagttcattccttccaaagctaagaacagacctaggatcattaaatcagtggatgttacaatgaccctaattgcagctcaatagaatgaaaatctttcaaattataaaagcctaataataaatggggctttttgttcttactcatttaacaattattttgagggaggctactgtacatcaggcactattctagatactgggtgtatgtcagtttacaaaagaaagaaaaatccctgctctcacagaacttacattctaatgggagagagaattacaagctaataaataaatcatatggtatactagaatttaataagtgacatggagacaacaaagctgggaagggaaaaagaaatggagagttagagatggacagcatggcttagttagaagacacctcactgagaaagtgcagggatcctgaagcaggaagaagtaagagaagccagtggtggctggagcattgggtgccaggggaatttagcaggctgtgaggaaaacgacattatggaagatccatataggtcgttgtgtggactttggctattagtttgagtgagacatggttgtgggggaagaattatccacacatgcagaattttgaaatatgtaatgcttttattatttactaaatgtctgcctgcagaaagaaatgggggggtggggatggggatcaccagcagggactagagatatacatttaaaaagaggttaaatatacgtttgaaaataaagggagtcacaattaagaacaaatggaagtgtgacattcaaccctaaaagaatcatgttaagaattattaatatttttgctacttgagttaactgaatatatgatatgaatttcttttgcttattgagtagttgattttgtcatcaaatggaaaggcctcagagggtttgagcagagaagtgacgtgattctttttatacttaagcagattactcaggcaaggaaaggcaagggaaagggaaaagctattgctgtaatcttggaaaaagatagtggcggcttgggcaaagttagtagctgtggaggtggtgagaagtggtcagattctggagatgtttgagaggtagagccaagagaatttgcacatggggtttgagaaaaaggatacaaagataattcagttatatatggcctaaacaactaggaggatgaaaataactgaagaaggaaaaccgtaggaagatttgttttggaggattgggtgggtggagattaggaatttatttttgaaaatgttgactatctcaggagttaatgagctccccatttctgatgtagcagaggctaatcagccacatacaaggcttaagaggggtaatgatttatgtcaaattaaaccagtgattcctaaatttactgtgtttccaaatcacccaaggatcttgataaaatgtggattttgacttatgaggtcttgtttgaggcctaaaattttacatatcttctaggcttctgggtgattgggtgtgatactgttactgtgttatactgatatgccacttcagaggctacaccctttgtaggagatgattaaatccattttttttacaaaccttttaaacggagatcatttaaaaaatatatttttaatgaatgttaacaatttttaatgctaaaaatcaaaacactatgaaaggttctgtgagaaacattaaatatcctccattctcagtctttcccactctgtatccgagtttgctctcggtggattctttttatagcaacaaaatttttgtaaacttttagttgatagtggttaacttttggaatctgtgactgagaaaatgtaaaataataaaacacttctgttaactaacaccttatatgaatttgtactttgttactctcaaaagcatctgatccagtagaaaacaacagaacatacataacatgttatttattcagtcactgtgcaatgcgtagcccaggtatgtattgtcattggccctcccttaaccctttaccttctttacttgcctcctccttgcctgataatctacctggtttataactgccagctcctggataggatgatctctgtttcctttaaactcaatctgagattctcctattctgtgatgtgttcaaccatatccctgatttataccatagtcctgaagcactgtctgacctgaagttgtttctttatcttacacaaccccttctcctgagaaatttttcaggtccttgtctcaagccaaaagagaagcaagaaacagttaagtaagatgttataaaggcagatttttaaaaattacctgtggtgaaagtgttttttcataggctgattagagattataaacaaacgagatgaaaatatttaaatatgtttatagcttaagcatattaataatttaataaattgtctgatccaagtgaagtgatgtttacaactaattgatcatgaccagttacagatttcttcatttcttctccaattccactgcttcacttgactagccttaaaaaaaaaagttaataaacatagttacacttctcttatataaatgacatatatttcttagaagctttatgttgtgcaatatgctggtgtatcctctataccttattaactatagtttgtatggttgtttctattaaataatgaaaacaagtctcagaaccttgagccatgttatgctataattgctatataagaattacactggatttatattatacttcctatgtcttttctgaatatctcatttctctgattctgagtactatgtgtaagcagtttgacttgattttcatggtttttaatgattttctaaaaatagcttttattataagaaatagaatagccttattagttattaatacaatagggatctttgagacatttatgcccttcctttgcatgcattcattgattaattcatttattaaatatacattgattaatatttgcagctattcaacagacattgagtgcttatgatgactagacaccaatagtagatatatatttttgactagaacatatggtactgtatgacttcacagaactcaagacttcaaccacattatcttacaattacattgtaatttcattgtagttctgatagattctgtatcataataattgcatgctttgtctacaccacctcccaaaatgcctagattgatgaaataagtgaaattagaagttttgaacttgcaccctaaacttttttcatggtctcatttttatcattaagtatccttacaacattctgttctatcttccgaaaattactgtaagaagcaagaatgatcccagaagttccatctagatttgcaattttcacacaaaggaatagagaaaagtgttcataaatttcattcaagtttttttctttttagaagtaataaagagaatagaaatatcagcattaattattcatgagtatatttaagtaaatacattaccttttcagtacattttaattggtcttttttgcaaattctgtttatatcctgttttttaaaatattgattctttaaaaatttagcttatgatttagtcttctgattatgaaattaaaataagaaaaggtaaaataacattttaaaaatttataaataaattttcaaaataccttttttgaaaatacatctacccttattttaataaacctatataactaagacatttacattttttaaaataaaaagataatcgtgtttatttttaaaaaatcaacaccaaagtgtatgcaatactcctccttaccagggcttattctgaatggtaaccacctccttaccctgtggccactgttagatcaaaactcacagaccgtttgtctgtatgcgtgtgtgtctgtctgtcttaagtaatggaattgtactctgcatagtattctttaacttgcttgtatttaaactcaataatgtattgtggtcatctttcagtgtaatcatatttagacttgccatcatactgacctgtttttgagctgttttagacagcaaagataaaaaacttcatgtaaacactgctttctgttttgaaccgagaaaatattcatcactattaaagttcaattaaaacttaaaaactcttatatactatattgtgactgagacttccctgacctcaaactttattatacattataaaatgtaaaagggaaaaatgttgttttcttccgtgaaatagttaccagggcaattcctgaagaacaagtatatcagcacaaataggaaattgaaattattatagcttatgtgttctttgttactatttgaattacaagggcaaagtaattcacaattcaacactggtgtgtgaattaaaatatcacaggtgtttgggctttaacaaaccactcttaaacattgtttatcaattctctgctcaacacctgtcatagtgttcagtttttaacatgacaaaatccctgtcttttaatgcaaaatgtatcttcctctctgatctgaccttatcctatactttaaatattaccactagttgcttctttacataagacacttgttcaagttaaatattttgtctaatccaataatgcttattatgcgcctttctgtggctcttgtttatgtatgcattttcaactttcttgaaataacagctaacttccagtttagcctttcagggtttttgttacgaagaactttacattgatgggggtttgtatcctttaaaaatgttttttctttgatgttcaactctatttttaatttttaaaaatccttaagaatcgcatctattttttaatatcttacttaaatcttgctctctttttgaaatttttcataatcattttcttagaagtaatgtctccttcctttggccttctacagcaatggctgacctacctttatgcaattataatataataatagtaatagtagcagcagtaggctgagtgcggtggctgatgcctgtaatcccagcactttgggaggccaaggtgggcggatcacctgaggtcaggagtttgagaccagcctggacaacatggtgaaaccctatttctactaaaaatacaaaagctagcaggcatggtggctggcgcctgtaattccagctacttgggaggctgagacaggagaatcgcttgaatctgggaggtggaggttgcagtgagccgagatcatgccactgcactccagcctgggcaacagagtgagactctgtctcaaaaaaaaaaaaaaaaatagtagcagcagcagtagtagcagcagcagtaatagctaacatctattgagtgcttcctttgtgtcaaagattctgtgcattgctttcaatgcaatgcctacatctcggtcgaacctcataataatctcatgagtcaggtattatgattatctgtattttagaaataaaatattcagtctgtagacattcagtagcttctcctaggccacacgtaataagtgacagaaccaggactgtcagttccattgctcatgcactttaccactacatctcgctgcctgtatctgagtttcttataagatgtaccagctgtagtttaaccaagttatttataaccagtttatagcatgaagtttgaaacttatttttgaagtttcaaatttatattccattaaattttgttattatttaaatgttccaaaaaactagtaagtaccatttgtagtgcattctccttgtgttccttaaaatagtcttagctaggatggacttaatattataaccttcaaaccacaatttataatgaaaacatttataatcccagtgtttgagctctttggtccttgaaggtacttgaacatgcaatccgtttttagagaattttcatcagaatgtgcttaatactgcatttattctacaaatatagctccgtagctaatgattttgattgccatcaaggtttttctcacatctcttatgagctctgagatgagtaatgaccagataaatatttacatagatgttgtatctgattaacaaagtcaatatattttgtggcttttatttataggagatatttaaaagtcattataaaacagaagtgttatgaatcttttctcttttctcctagtaaaatttagttattaatctagttgtctcaaaattatgaaagaaaaagagatgttaaaacttttgttaaatatctctcttcatcccattgtatacttacatatcagtatttttataaattgtggtaaaaaatattggttttattttaaaacaattatgactattttcacatgtattttttatatagcaaaattatagcaaagttgactaagtatgttatgaaggcttctagtaacttagatttttttcttcccactaatcttgtgcaattgagaaatactgtgttcaagctacatatctgaatatagagtttatagaattagatatataaatttggaagtcatctaacagtatatatcgaccacctatatcattgctctgtcatattttataaaatattaacaaaagctcttcatacctattcaaatagattttttaaaatagtgattgtaacataatttacctcatacttttttcaagagtatttcatttgttataacagaactttaaaatattaaaagcagagctttttacttcggaggtatttttaattaaaaagttttttttaactttcatctttaacttgagagaagtatattcttcttgtaattgaacatttgtgaacttctgcatataggtttttgttcatgccatgaatatttctgggttttctgaagtcccttctggaattttatctgtgactaattattccatagctcctttttaaacatcgtcaattgtgaggtttttcaaccgttttacatttttttgcagacatttgctaatcctttttagtgcattcagtaccaatagatttgattctgatatgggttttaccttttctccatagataatttcattctcataaaacatgtctacaagcattatatgaaaactgcatagtaattttggcaaacttttgaaagacatcttttataagtgagacttctgaaaggtgtaccctgttctgtggcagtttaatccatgaaattttacctttaaagaattataaaagatagggagctgattcacttttcacccttagaagacatgtgttagtaaaattcttccagaagtatatacagaatttgttttccatctgcttattgctttttttgtgagcaacttttgcaacagtgtttgctctgtttcttactatgagtctgataacacaccctcagccacaggaagagtgtgaaaatatgctttatttttaacatagttgatgaaaaattaactttaattacaaatattcactttatttcattgtattttattgtattttttgtgttaaatatttatgctaacggctcaattttaatagcataaatatttaacacaaaaatacacacttcttcagcagaaatttactgttttatataacttagcagaagtttttttaaaattaatctaaaatgtattttaattttttaaatgcataatcaattcactgaggggtgtttttttttttttttttgagatggagtctcactccgtcggccaggctggagtgcagtggtgcaatcttggctcactgcagcctccacctcccgggttcaagcgattctcctccctcagcctcccaggtagctgggattacaggcacgcacaaccacgccggctaatttttgtatttttagtagagatggggttttaccatgttggccaagctggcctcaaactcctgacttcaggtgatccgcccaccttggcctcttaaagtgctaggattacaggcatgagccgtcgtacctggccaatttactgagatttttaaaatcatagtttactaaaaattaagtatcttattgaaggttttaaataaattgaccttgaggaactaccaagtgatccaaatacagatatttgcaagtgacataattgtttcatgcattaaaatcttgacagtagctttaaaaaaatttttaaactccaaattcatttctcttgttatgtatatactcttgactaatttttaaatggtcattctgacttttcatagggttaatgttcccaatatgaagtaacattaatgtgaccaatgaaattcatgattgagattaactaaattttttgtcttgttttacatatatactttaacagttgaaaattgaggaatataaccaatagaaaatcatagacaagattaacattcttttattgatgagcttaacatcattaacaattatgtttgtatgcttcaacacattgtgtttattttaaaataggaaaaccattcttttttatggacatgtttataatagcctttctttattcctgatgaatgtaactcaaggtatggcatctctcctttatgtatctttatggtttctcctaaaacctagcttatcatctttaacactgagctgtattttctagatgcagtgttaagattaaattctacaaatccccacaaaactgtttcctccttcctcctcccaacttttaatttcttcctaattatataaaggcattctcaaaataacctttgttttggtttttggcaaaggtatgtttcgtatctggtgacattatgaccctaatcctataatggttagtgttggtttcaaataattcccttttagtaagtcagagagagagagagattgggatagtaggtatttagattaacttccctaaaagctttgtttgaaaatattatcggcagagttttagtgcgtcatggtattctgctgatttagttgaaggctttgcatttacatttggccctcaccaaagtaactgcatcttttgtggcttcctgtagcaggatataggtttccatgaatatggtttctatttactgccaaaagctacctcaacaacagtgttgaaaatgacgataagttctaccatcataaatttttgaaatgttttttaaatgtatttacttttatattgccacttttatactttcttctagaaattcatgttagaagctacagaataatagaatgtttgggttcccatcataacagttttgtgttacgaatttggaaaatctattttatacttctttctaatatattttggttatattaagtacactggatatataatatcttactataaccattcctgctggtgtactttcattgaggcactaacattatcatgtgaaattattatctaaacatctctgagtttaaagacaagtgagagaaagcatagggtacctttaaaatacatctttgggacttctggaatatgatggctgttcaccataaccaccaacatataagacaattgtccaaaatatggtaaaacattgtgctactgtcttaagtgtctgatgtaaaggaagaattgcatttttctcattaataacaaagatcaaatattgtaacaaaagagtaacctgcaaatttattcctatagctattcatatagtgtaacctgcacatcatcataaaaggcttgaacagaatgaatggatggatagatttttcaaaaaatctttgaccaacttcaagtgtgagaaacctgtaaatgtgagaagcagtgttggctttgtagttacaatttcagaatgatccattttaccctttgttgactagtgtccattttcagccagccccctcatatcccctaaaccaaaatagaagctaactaaaaagaaaattaagaagcagacatctattaattaatttaatgtgcagaattaataataaattacctctacacattgtataagagcactgctaagccttggtaagataaaatgctgttaccaaaaaaatcctaataatttttacatgaaagcaagtaaataattattttccaaaatactaatttaaacaataagtcttaaatatatatgcttactttatgttgtattgtattctgtgttcactgaggtcactgtcctagaataaacactataattttgcctgttttgtgtactagaaatacttatcctgtttgaagaacttccatcctctgtggtgtagacagatagctcctcaatctgaaacattttccttgctcatcatttctaacattgaactttgagcaaaaaccaaatatctgaaaagcattctacattgagaaaggtaatgaaaaatacaaacatgatcctaaaaatgggtaaaaagtcagtgcatagctaatttttttctttttacttttttcattttttaaagtgagttacaacttacatataggaaagtatatttatcatttgtatacagttgaatgaagttttacatatatatagacatgttatcacaacccagcaccccagaaaccttactcattctcattctagcctgtatttggtagtgcaaagataatcattattctgacctctgtaactatgtattaggtttgacataactaactgttattatcaatgtttacattgtgaaaacttttatctcaacataggttgtcatctgtaaatctacttgaaataatttctgagccaatgtcagatcatataattcaaaatataaatgattttaatccaaattttttttttttttttgagatggagttttgctctttttgcccagagtggattgtaatggcacgatcttggctcactgcaacctctgcctcccaggttcaagcaattctcctgcctcagactcccatgtagctgggattacaggcgcacgtcaccatgcccagctaattttgtatatttagtagagacagggtttcaccatattggtcaggctggtcttgaactcctcacctcaggtgagccgcctgccttggcctcccaaagtgctgggattacagatgccagccaccgtgcccggcctgattttaatcagaatttaaagcacaattttagactttagttttaaactttaatatcaaataatatattatccactctggtattttccatgtaaatctctgaatgcaaccataaggaaaaaaattaaaaatccatatatgaagattaaacattataatttgtaacatcttcattcattagataaattcctagcatataccctaataactggctgtagcatgagcttttgagccaatttttatcaatttcacttaataccatagttatttagtgaaaaatgtcatatacatatgtgtgtggcatttgtacaacatagagtgcatagcttctgtaaaggaaataatgttttgtatcctgggaccccattatcctttaactgaattgactgtcatccaagtatgggtttgataaactgacacaacagtgaaaagaatccctgtcccatgtcagcttatcaaacacactgtggacagcatgtctttggcattaaacgtattcccagtcattaaagttctgaatagaagtcacgaagcttatgttcagtgagacacaacctcagtgtttccaggtgattttaagaacacctgataaaactgaggtatagtaccactaaactttaagaattttccaaaaactagggaaaaaaagtaacatgcatagagttacagaattgcagtgttattgttcagttcgatgatagaacttatattaatgagatatacagaaaagtaattaatatcttgtccttctggtaaaccatgtcaaattatgctgtaaatatatttatactgtagaataaaacaaaatcaaatatgttttgattttttaatcctttttttcaaataataacgtatatccacctggtaaaattgtccatcggtctgaatctctcactatttttttcccaatttcatttatttaatttgaaaatgtctatcatcaaaaatttagcagccttttttggaatagtgcactaaaatcatttgtacattgtccaagttaaagtataggcatgtttgaaaaagatttttaaaaatttattctagtgctgtaaatatatttgggtgaaaagctaacttctatggtgatgtaggtcaaaacgtttacttataataatacttcatttatacatatctataataaaatagttaaatctataacatttataggtgaatttgcctgattctatatcatatacaatgcgaaaacatctttcaggtttgttctccatagtttaaccctcaaagaagaaattacattatgcagttacagtaccttatcagtggagctcgacttctacgctgcaaatggaaatgtattgcaacagtgctaaacagaagttgccctcctctttggagaaaattgcagtatccgagagctctttttaacaagggactacttttaaatgtgtctgatcacctcaaaggataagtagagtgtttcctgccagtagaattagaggaaggaagcaccaggccaaaatgtttgatgtgtgatgtactgtaattcttttcatgtgtttggtggtggcttttatatgatgatcagtgttttgctactatttgtgaccctggtgtggtccaggtcattaaagttcaaccttccttaatgtgtagggtcattaactatacctagcagcattatcataattaaggtactgttttcttttaaacaactatgtctcattttcattaaaatatttcttataattggaaaatcgacctagtgattgtgattctcatgaaagagattattcaacattggagacctgctagtactagcattactgtcgacagatgctctttaggtttcctcactttaccttttagtccttgtttttaaatcagcattttcttcccacaattacctgtgggtatataaagttcaagatggaaactagctttacatggtagttttcctggatgtgagtcttagaggcaataagaattgacaaaattgctgtcagcaatattatatacctttaatgaaacaaaatgtgatgattatacatgttctttgttattctgagatcacatattcagatattcctttaaatgtttaggtttttaaatatttattcagtttaaaatatgtaaaagtaggttctttattctttcatctttatctttctatgccctctaaatttgcttttgggtttttttaaaacttttatatcatttgttcacccattagtcatttagcacttgacaatttgacaatgatagctctaaaggaatatatgctctgttttgggatatgtgtgtttatctgtgtctgagtgtgtgtgtgtttgagggttgtttatttgaagagccagtttcatcttttcccgcatgtgagtatccagatatttttggtatttgccttctgtctctttcaatgctgatactggatatatcattaatacattaatttgaataaagctaaatgcctaaaaggatcttcatgtgataaaataaattgtctttcctccatgcataaagaatcaattttattatcttacttattgatttctttagaataacttgtgaacacctaccattcgctagctatttgctagctgtaaagctgcactggtgacaaaattattcataatctttaccttcatgaaacatagtttaattgactttatcattatacttaaagtatattaattgatttcttgtaaacattttctctaggcaaagaaatacatggcacatttagattataaaggaagaactcacagaattttttatgtcctcagtgtagcaatgtagtgcctgcatttattttattccataagaaagtatttcaccagttttataaattaagctattgtcgtcatagcttactcacttttcaagtcatggcttatgatattaatatttaagatctaaatgatgatgattacattgtaagcataatgaagaacaatgtgaagaaaattttaaaaataactgaggcctttcaccattaatttgtaaataattggcctttaaaaaataggtacaataattttctgcacattcttttgcattatcttgcagcatattaaaatatagatatacaacatgtataattcaaaaacattaatatttaataagaatgatgtatgattataatttttgtattttatattgtattttaatgtaaatgtgatttattaatgtccacaaaatatgaattgcagacagagtatttggagaaggaattattgatacataataaaaattaggccagtgccatggctcatgcctgtaattccagcattttgggaggccaaggtgggagtattgtttgaggccaggggtttgataccaacctggtcagcaaaacaagaccctgtctctacaaaaaattaaaacattagccaggtacacacctgtagttccagctacttgggaggctgaggctggaggatcacttgagcccaggagttcaagattgcaatgagctatgatcatgccactgcactccaatctgggcaacagacctcatttcttgagaaaaagaattaatttgatataatgaatagatgtatttaaataaattggtaatggaaaagatgcctgcaaataagtattgatgctaacttattggaagtatattctgtttctttttttcttttttgtaccataaaacagaaaaggactcatttatttctataagcatttatatatatatatacacacatatttatatttatacattatatttatatatagcatttatatataaaaatgcttatagaaataaatgagttatataaatatataaataaattatatatatatatatatatatatatatatatatatatatatatatatatattttttttttttttttttttttttttttttttttgagacggagtctcactttgtcgcccaggctagagtgcagtggtgcgatctcgactcactgcaaactccgcctcctgggttcacaccattctcctgcctcagcctcccaagtagctgggactacaggcacccgccaccatacctggctaattttttgtatttttagtagagatggggtttcaccatgttagccaggatggtctcgatctcctgacctcatgatccacccgcctcagcctcccaaaagtgctgagattacaggcgtgagctactgcgcccggcctaagcatttctatttttaaggaatactttacagaattaatgaaaaaagagatctaaaattcatcaccagctaaattgggagtcatttttgtagcatctctttcacagctagctgtttgacctcattgttctcagttcataaagtttatattgaatgcttttgcctcagcacatatgctaaggtgtgaagaatatcctttttcacaagactttcatgtctcaattttattcatagaatatttcctagctatttctccacttttgaccatgtcatttttagaactaaatttttgaaactgaagaatttatcagtaaaataatattctatattatctcagtttcttttgtatttcttttgaaagatacaaaaactttcttgtttttgcatttcttttgtaaccaaaatctaaaaactgcataattgttctgtggatttttattgtggtttcgaggccctatttcgaataactgtactttcatgttttaaatgtttgtctttgctattgctcggtgttttcttttctattacagggttattttcttaaagtgtatagagtcatggtatagaagcacaaatactaagattaaatactttttagtcgttattctgcttataaaaactgccaaatgtacattgtgacttttttatatgttgcctcaattctccctatgtgttttctgttttaattatagcttagaaaatctctaggggtaatatatttataccctatatactgtattttagtattacttatctgtttttaagattaccaaagaatattgttttctggtatcaattaaaacttatataagaatttataaacagaatagacaatatagtttaaatattttcatgaaatatttggtattttctgactaaagtcaaccctatgtggctaaagcttttgatatggtactaaatcaacttttttatattcttaagaataagcatggcacatttttttttaactttaagttctggattacacgtgctggacatgcaggtttgttgttacataggtatacatgtgccgtggtggtttgctgcacctatcaacctgtcatctaggttttaagctctgcatgcattaggtgtttgtcctaatgctcttcttccccttccccctgcacccggacaggccccggtgtgtgatgttcccctccctgtgtccatgtgttctcattgttcaactcccactgagtgacaacaaggcatagcacatttattattcccatatttgtataactcttgccatgttaaaacattcatgccgaaagtaaataaatctatctccatactttggtggataagatggggaaaaagatttttacattctaatttttccttaagaaaaaaatgtatctttttattaagaatgccctaatggtgtttcatttcccaagtgaaataggtggtgatctgttctcagctttattaattcctgaatgcatggataaaatattatacttgaagttcttatcagtaataatatataatatgttaaacataattattgctggaaatctgaatagtgtttaatcctagatgtaatggagacctttctagaacctccacttgcaggattaagtttctacagggaaaagttttcaaaagaagcaaattctaatgccaaaccttggaacatagctagcacatttcttcaaagtatgtaccttcattattgtatttttagtagatatggggtttcaccgtgttagccaggatggtctccgtctcctgacctcatgatccgcccgccttggcctcccaaagtgctgggattacagacgtgagccaccgtgcctggcctaagcaataataaaggcttaagcccggcctttattattgacatggacatcatcagaatttcttgtcacatcattgctctttagaataatagagggtcctaataatatctatataatttatcacatcttgattatggttagtggataagggagattttctcagagaggtttcttggtgctatagtagccactgcaaaactcagtggaagagttggaaataggtgagactttgaagaatatgttgagctgtggcaaataggccaggtagaggaaaagaaggtggtcagaaaatagaggcagaaataaagcatggtacacttagagacatgaggatgcttgttttttgtatcagagtacttgttattggggcataatgagagagatgtggggacaagtgattgagatcagactgtggcagctttgaattcctggttaaggaatttgtgctttattacataggtggatggagagcccttaagtatttttgatcaggtttgaaccattttgggagaattaattacagtgccaagtacatagtaagtgtttaaagagcacagcctttccaagtgacctcagccaacatacagcacttaactccctcaattttatttgtaaaacagggatgataatactacctacctcatagggttgttatgaggattacataaattaatgcatataaaacatttaaaacttgtctggtactttgtaagtattcagtgccatcccaatcaagctaccaatgactttcttcacagaattggaaaaaactactttaaatttcatttggaaccaaaaaagagcccgcattgccaagtcaatcctgagccaaaagaacaaagctggaggcatcacactacctgacttcaaactatactacaaggctacagtaaccaaagcagcatggtactggtaccaaaacagagatatagatcaatggaacaaaacagggccctcagaaataacgccgcagatctacaactatctgatctttgacaaacctgagaaaaacaagcaatggggaaaggattccctatttaataaatggtgctgggaaaactggctagccatatgtagaaagctgaaactcaatcccttccttacaccttatacaaaaatcaattcaagatggattaaagacttaaacgttacacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacaaaatgggagaaaatttttgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacactagttagaatggcaatcataaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgctagactggattaagaaaatgtggcacatatacaccatggaatactatgcagccataaaaaatgatgagttcacgtcctttgtagggacatggatgaagctggaaaccatcattctcagtagactatcgcaagaacaaaaaaccaaacaccgcatgttctcactcataggtgggaactgaacaatgagaacacttggacacagggtggggaacatcacacagcagggcctgttgtggggtgggggtcagggggagggatagcattgggagatatacctaatgctagatgatgagttagtgggtgcagcgcaccagcatggcacatgtatacatatgtaactaacctgcacaatgtgcacatgtaccctaaaacttaaggtataataataataaaaaaaattcagaagtatttactgaattttataattcagccgtaattattatacttattgaatgtttttgaaatgattgcttagtgcttagtctgactatagtatttaatatattgattgaattgtggaaagaattctacctaccgctttttgcttatgcaaaattaaataagtaaaataccactgatgaaatgagaaattgtaattttgtatgtgctgcaaaacaacaacaacaacaataaacctttacaagcatccttatcccagctacacaagaggtttatatcaacttaaaatccccagataattttcaacttgtttcaagccctgcctaataataggccatattagtagctagcatttagatagcattttacaggttacagagtacttttttatatattccctcctttagatttcaccaaatccttaggcactactcagtgctgtaattcattttacagtggagaaaacgaagctcagggatgcctaagatcacacagctagtttgtgctctgaaccactacaccataattctgtttggcctttttattgaaacaactatatcaaaacaatatagagtacaagaaaatgctttttctatgcccaccaccttcctctgttctgtaccttgctttttaaactctgccatgtaagactcatcacttggacaaacataatttcattcatagatttttactgtgatattctattgcatgaatatgccaagttattatgtcattccttctgttggtggagatttacgtttttaatttttctgtatcacttgtagtgttaaaatgaatattcttcaacattctccttgtacgcacatgtaatagtttttctagggcagtgccttctagtagaatgtcctgtgatagtggaaatttctgtatctgcactaatacagtagccattatctactgtaactactgtaactaatacagtagccgttagccatgtaactactacactatgactcaaggaattaaggagctaaattttttaaattgtatttaattttaattaattttaaagagacatatacagctggtagctattgggcagcataactctgggttatgtatctaggagtttaattgctaggtgataggttacatagcctcaatgctgatagatttcacgaaattgtgtcagatttatattctcaattgctgagtataagagtttcgtggctctctggcaaacagccttaatactgttgcattaggcactatacacttaggattatcttagtactagatatttgtggatgatgtttaaggaaagatattttctctctacaactggaggtgataaactaatggatggtacctagtatgattagatatgctttctaatgtatggcaattgaagggcattgtgctactgtcaggaaaatatattaaattttctaatcaaatgttagactatgtagcccttgttgctaactagaagatcatgattgatacttttccttaaagaaactatctttattctgattaatttgcaaattaagttattcatattttaacatcatacattaagagattttatggactgttgctgtatttttaaaaattcatacctttctttacaaatagagaattgcttaatgattattgtaagtttgagaatactaacttctgttcctattctttcttcttgaccgattttataatatttgtgagtcggaagtaactccatacattaaaaaccatgttaaataatgtgacaacatttttttaaagggagttgatttgttatataccacatctaaaggttttttttttcctcctcaaatttcctgttttaaatcaattctaatctgttgccttggaattagtctttatcatgtttaatttgaagtcttacagtttttcatccaacaacatacaaatacatttaaataaagcatagttttacattttattttgaaggctagttctcatattgttaggtacagaacgtaggcgacaagaggggactgaatttatagtcagaaggtgtggtttcccatttggactatgctgtttctcatcctccttacctaaatcatcagcatctgtaaaatgaagtctacctatagcaccctgtgagttgtgatttatctacataatattgaaacccctttgcaaaccattaaactgtaatcaaatgtaaagtggcattattaatattattactatcatttatgtatttctgtattttgtattacaaagctcttcataatttggtagtagaattggaatgactggaaatgaaagaatgtaattaaagagaaaaaaatttaagtgatataattagagacatagtaataaaaatgaatttggttaagagataaagggagatatctttgttagaattgttattaaaggtttcccaaacagtttggaattagtacttgtttacgtacagtttaatttagccacaatttacttttcataaatatttttctatgattttttcttattatggaaattatttagaaaattaagtagaacttgacttttaaaaagtaatgtactatgaacatttggggaccttatctgtgctcaccttggttcagatagcagagatacattgttcaaagttagagagctgtaatgacccaagtatcagaatgtggttttgagaatcaatagggatgctagtttagataaaaaagggaaaagagggcatgttcctcagcctagtccagaccttctgaatcataatgtctaaagatgggagctgaatattttgaacaaactccctgggtgattcttctgcactctgaagattagtactcctgccctaatcgttggtgatggaactcagcatttgtttcagtctgacagacaattattatatcccctgtcctatttactctcaaaattactgtcacttatggagacttggtgataaatatgtagacatttaatttaatcaaggcataaaagttttacttctttttcattcctattttctgccttatttaacattttgtggatctcaattgagctataagtgaatgaatttcacttctttacagtgaattcccgagatatgcctattcagcagtgagtagtaaatggttcaacatgagctgttccttatgtaaacatacaaaaggcctgacccagactaaatcaatttaaaaaggaaaacattaaagctatgtttcctgttatatacttaaagtcttctttggttccttatgattacattatcgaccaactattgcagactttatcctcctacaccacctgctgaatggttcaaatggtatgggataagagtttcggaagggcaaagcaattacaattataactcctacattgtagccaataaagcagctttttgtgctaaggataaggaagtcatgggcttcttgattcaccccctttcctgatttgaattgctacaaggttttaaaggctgcaataaggagacagcaaagttcatagagcttttagaagtatgtgaagttgagaccagaaaatttaagtcctgtttatgatagcaaacatttctaggaaacatttaattagtaaatgaaacaacaatataacgcttttttattataagatgtttacattgtattttttaaggcagacgttaacattaggcattctggtcctcaccataggaccagctatagtcctttacctatgattagctgcttagtaaagtatcattctattagaattctttgctctaattattctgcaattgttgtttgtgctaggaaaacttggtgtactaaatcaaagttctcttgaataaaatatactttcatttttggcattgtaatcagaatgtttttcactcctacaagtcttatttttaagttataaagttcttttcttagggaagggagctgtaaaattgtaaaatgattttcagtctttgaaaaaataaattatttgtgaatcttgtgtctgtaactatttaccaaaaactttaaaaaaactctagtgagccatgagatgtgaaatatctttcagaagacatcttgccttaatattgcttaatgaaagttaatgtaccccataaatttatacattatgatttttcattaaaaataaaaattttgaaaagctagcatatggtatttgaaaacattttgaatatgttttcttaatttcatattgaaaaagcaaaaatgcttttaatatttcataataaccgaaattggttttaagtatgtataggacaaaacaggagtatatcttacacattaaaaaatagagattagtgactatttcaagttgagggaaaaaatcctcctattttttggaaaatgaagtaaatcagtgcattactactgtattttcttataacgataaagaaaaataaatcttggggattatgtaataagaaagaaaaattaaatttttatctgcctaaaaaaactatcctgtatttgttttattagagaaaaattaaaccaaacttgtaaattttatacatattagctaattcttcaaaatataatattttattaactcaaaccaataagctaaatggtctacctttataatttgtaatagaaattttcatttgtacttggaaaactatctacagaggagatacattgatgtttcctggttttgatagctcaggagactaagattgttgaagaaactgtgttttaaagatgcaagaatatttttatttcgcctaaattttccacaataaagtttttcttggcttagaaagtaagaggtctattgcatactaaccagcatactgttaaaacactgttaagttgatgaaacagatcaaattagaaaatgtgggtagaattcattgagtttgatttattaaattgagtatcactggtgttctctgctcagctgttgtttctttttagaatcctagtacgtgctttatccagctaagtctgtcttattctcactttccagtcattttacttctatttgacattttatacagagtctgaggaaagatttcaaagtagggttttttttcctgacaatttttgaagtttttatgatgtgatgacttctgtgccaggctctctctatattatctcacttaattttcataattaagacagaaacccaggtttttctctcctcttggctattgtgctactacagaatttatgcaacctatttggcacgggataaaatgccagtttgcaaggcaagcccatcttgtgggctgcacctcttcctcaaacactgggcctcatacaagtctctgatagttggtacaaaacggcctgtctttggctggaaacctccatgccttataccattgctttctcccctgcctctctccaggcccgctgttcagagccttttcagggtttctagatgtgctactgcctcacacctttcagcctttgaacctgctacttcctctgctggagattctttcttgtatgaaatgagataactgggcttttttgaacttgtttctatgttgccttcctctttcctgggcctcccaagtctgggtcaggtgtcccttctatgtgcttccaattttattttatacataaccttttggagtattaagtgttgtataattgcctctaaatcccacattagactgtaagtgttatgagggcagggaccatccagggacctattattcttagggcctatcacaatacctgacatacagtgcccaataaataatgcaagtcaggtcactggaggaagggctgttttgataggagaatataattttgaagtcctgactaaggctatgagtagggaagaaactggttgctttataccacttactactttactagcagttttattttataacaatatggttttaaaatagagtcattttcatgtagaaaaagagttatagaagaagtaatgttatatttggtaggagaaattagaggacgctatattaatagaaatatcttctagggacagtgacgactaggagagattttttttttttttcacagtaagccgtaaaatctttgttgctataaatcttcctattcatttaactatttaatcttcacaacatcctagttatgtttccttttttcttgcgaatagtatattttgccttctatctttatctttttttccctttaatgctagaaatttgtctatttttggctttgttgatcttttttattgtgctctatatccttccctctttcttttagtttattctactttttatgttcagcttattgagacttttttatttgctaaaactagtattttagacaataaattatcctgtgccacttgaactgcatcctacaatgtttaatgcataacatttgcttttaagtattaacttttattatgatttttttgaccagtggatgactcatttagaagtgtgttttaaaatttctaaacataagcagttttgtgaattctcttctttaataaaatatctaactgaattgtattgtgctcagaggatacagtctatatgatactaattcactgaaatgtactgaggctagctttatggcctagcaggttgtcggattttataaatgttcctgtgtgcttgagaaaaatatgtattctccagttgtcagatactgtgttctgtaaatgttcacctcatcacacatattatgtttttcaatttttctgtatttttcttcttacctgcttagagggttaaagttttccaccatggaggacagatttgtcagtttctccttgtagagctatcagtttttcttttatatgttttgaggctgtttttacaaataaatttagaattgtcttaacctccaaatgtactgaatcttttgtcttcaggcagtaactatttttaaatagagttaaagtctatgttgtataatgtaatgtaaatttaattacttaagttttttgtcaaatgtttgcttagtatatatttttgcatatgttgactctttctgtgccctaaagttttaggtgtgcctcataaaaaacagaatattgattgatttattaaatgcaatctgacagttcttatcttttaatgggagagtttaaattatttatatttatgctgcttattatgtttggatttttatttgtatcttcttcttaggtgctttctacttgcccaactttggtttttcatttctgacattctaatttttatttatttggaagttatgtgttccatatctgttattttagtggctactctggctatgttaacatgtgtacttaacagaagtctgaagttaatatctttttcttcttcttcaacaatacaagaaacttagaacattttatctcaaattatctggtccccttatttatatattattatccagtgtcttatttttggcctgttttctcatcacaatttagacatcattattattaatttaaacataatatatgtttagacttagtcatatatttaccaatgtcttccttatgattatttcttgggatactttgggctgcctggatttagggcttggcatttttcaataattgtggaataattataagacattatctcttcaaatattgcctcctccttgttctgtctattacctccctcaagctttaattaagcattttttagactttctctctctattctccatgaatcttaaccttctttcatttatagtatttccttgtctctttggattaaattctggatttcattggacctttcttttaattcactatcactttagctgggcttaatctgcttgagttttattttttttctcatttgtagttctacatggttctttttaaagtcttgttccctgctcatactttgaagatgcttttttactttttaaataattattttatattttatgtttgctagtctgtccattgttactgctgttgtgtgaattgtgaattttgtctgtgagtgtctcatttcacttggaacctgatctgtggaagttctttgagttgaaattgatttcatcccaagagactgtgcttttacttttgcctttacatgtcatctggcagcactgtctacctggagcaagactgtccagactgaatttttgttcataccatatgtgagactcaaacttccaagtcctggctcatgactgcaaaatcttggaacattgctttttagtttgggttttgtgggttggttggtttttattttgtttttttttttttcccctttacccattagtaaggtaaagacaggtaagttgataaattaccttgtccatttctacatgagcataaggagaactgttgctttaaaaaatatattttgaaatatagattcataaagaattacaaaaaatatttggagaagtcctgtgtgcactttacccagtttccctcaatggaaacgtcttgtataactatagtacaatatcaagaccaggaagttgacattagtacaatcaatacacagttgtattcagattctgccaattttacatgcacttagttgtgttaatgtatatagtgctctatgtaattttgtcacatgtagattcatgtaaccaccatcacaatcaagatacagaactgtcctatcaccacagaggtccgtagaagggctgtttctaattcaccctttcactactggtgacccttcgtgatctcagctttatgtgaattgtcttctattaaatagattcatcatttgcgtgagccctgagcttcatctcctcctgtgcagttaacagagcagaaaatcagtatctgcaggatttagcagaaaaccttagagtaaaagccagctttggcaggtgcttatttatcatggttcctggtttcacattatttgggagacttcccagcttctgttattctgttattggtgttggctccaggatgtgtctgaaaaaatactttagatttgttaaagcaatttgttatgagagccaggaggttcattcagagtttctaatatgccatattcagaaataggtgatactagaaatgttaaggaacatttatctttatcgttttcgttgcagttcattcataaagtggattttgttttatcttgatacttgtgcatctgtgattagttggtgatttaaatatgctgttcattcagaatcatataagataatatacttccataatagtcataaaatctacaaggtactttatgaatagtttttcaattacacatatattttatttatctttataatagtcatatcaaaatagctaaagcacagagaagttaaataatttctgcaagctcatgatcattggaaagtctgagactaaaactcacataaatcagctgcttatcctactttccccaactgagatttggaaggttttgcaattaacttttaagttggatttatatactcaaatattataaattactctgaattttttcaaatcaagtatgtcacatatatgtcaatatatcaaatatatagtttaattttaaaagcaagcaataagaaaaaatatagaaatactaatcctaatccctaaaagtttgaaatttgaaaattaccatttttggaagtatctggctatcactcaaaatggaaagtatttttgcatagggaagaagaacctgtgggaaataattgataaatgatggcaggagaaacatagcttaatttaagtccaaaaaaaaaatgggaaatttcaagcctaaaagcaatgtaaaagtctgatgaaacttggtgtttttgtgattgtaatcttgttaattatacagcttttccatgtatcaagggaaataggaaatcggttgtttacattgggattaggttgatttgtcttttaatatagcactaattttgttttcattttttttccttcaaaggtattcttaaagtattttagttcaccttaaaaatatgtttagggagtttatttaaaatgtagagagcattggctgttttaaaataggtaaaagtaatgtttatatggtgagtaataatctagggaaataggttaggccatcaactgcctcagatatttgctggctatcagaatttatgtggccctgattcaaaagtttagtcttttaaagactatgtgctcttattgctgtgtacagataggttctccgcctgagatttgtaaagatttatgtcagtacaaatcagtgaattgaaacagcatttacctgttgctagatagtatagatagttcctgacctcaagaatgtgtggtatatttgggaagactgataagtcaatgtggtattattatatttacaagcatagagagaccctaagaacagagatttgggaaaggggagtttggaggaagggtgatcaggaaaagcttcataaaaacagagttagctgagctgggcctttaagaattaacaaaattacaccaatatttaaatgaaactagaacattcttctacagagagactctcaaaatgcctctccttcatacccccactgtcattcattccttttctctttaccttaaggcaaattgaaaggattaatggcccacttatgagccctatttctcatgcagttcttgagtttgtataaaattttagttcacctttcctgtaatttttctaagttagaaaggagaaaacacagatccagctcctaccttaggaatcatgagaattatcctcagtttctctggctcctgctttggcttgttgaccagtggctgtttgttccccttttcccgtgttcataactctttctgacatctcactagctgagccacttgcttattccactcaggtctgctccttgcttctctcttcacttgaattaattaatgtcagccctcaccttgcctggcccagtcctgagcagctggcccagacacccgttgtcttgagtctgagcagtcattcactgtccattatcatttaaccagcctctgggagtgcttgttctgacctccacaccttcttagtcaaccaaggcataaactgaatcagattttgcctttttctatacttttcacactaggacccccatcacctcccaataataagtttcgttagtgttcaactgatgtaattaacttaattgtatttttttctaatgtctgtaattgaagcttttaaaaatatttctactagtaaggctatttttattctctttgttatttcaacttttcttctgataaaaacttttatgggggccaaaagctattttttcttttgatcatctactttaaaacttttctgaaccaacaaaacttaacataagaaaaaagccccaaattcaggcagacttaagttttctctggctctcaaactttgtgcttcccaccctaccttattgccttgctattttactctaaaaccttcatgaaaatttttatgtatttacttcctttaatttaactttacagattattttattcatttacttagcagtggacccaataggatcaacgttgtatgttccaactctatatagggcagtaaacctctctgttattctacatcagaaaccttgtcatttctcaacaactacatttgggttatataaagaatgaagagcaagggttgaaggggtgaaatagattaagaaggctccattacctttcctaacaagaaatcaaagctcagaagaaagtagacgattagcaagggaaagggttttgagtaaaaaacaaaaaacaaacaaacaaaaaaccctgtatttgtgttgtagttttgtcccatactagttttgtaactttagctgtctttcaaactctgtgaattattttctcattggtaaaaatggacataaaatagaacctcagagcatctcagggattgaaatcatgtatgtgagagtacttagaaaaagagtaacgtgccaggaataacataataaatcattatagtgtagattactgtaagtgataagttttggatatgttttcaagtcataatatgtactaactttctgaaacctttttcatagatgtgccccagtttattcatcagtaatccaaaggaaaaaaatggtattgacactatgttagtgaacaaaataaacatagaatggttattttatctgttttcttgtttttatttttgtttttttcgctgcctttacaggagagccttgaacttaggaattcttcgagatcctggatcagaaatcgaagacagacaataccaaatagatctgcagtccatcaatattggtactgcacagtggcatcaactaaaaccagagaaggaaagtgtctcaggaggggtggtaacagagactgaaaggaattctcaaaatccagcccttgagtggaatatggccagcaggtaggaaatgattgagaaactttctactctttctaatacttcattgccagaatagttggtgatacaatctttagcatgtccaaccaacctaagtattttggtattgcttctgcttttcattataagcataaaaaatattttgtaattgtagctgatgatttggcatggaaacctgctagtcctaccagtgttacactgaaattattacaaatttaggattatgttagcatagaaaaaaaaagcttactatttattgaaagaatctacttcaggctaaaggatacacattttctcttaaaatctattgtatttggggtcaattgtttgatgtttagactctcctttttgcttataataacaagaaaagttaatgaatactctgcaaagttatgtttaagttagagtgtggggaaaaacaagagtttctggctctagggttttttccatccactttaactaaaagcaactatgttgatagatctttttaaattttttttatttcaatagttttttgggtacaggtagttttgggttacatgtataagttatttaggggtgatttctgggatcttggtacacccatcacctgagtagtatacactgagtccaatatgtagtcttttatccctcactccccttcctcaccacccccacccctgagtccccaaagtccattatatcattcttatgactttgcattctcatagcttacctcccacttataagtgagaatatatgatacttggttttccattcctgagttacttcccttagaataatggccaccagttccatctaagttgctgcaaaagacattgtttcattcttttttatggctgagtagtagaccatggtgtatatataccacattttctttatccactcattggttgacgggcacttcgattgtttacacctctttacaattgcgaattgtgctgctattaacatgtgtgtgcatgtgtctttttcatataatgacttattttcctttgaaaagatacctagtggtgagactgctggattgaatggtagttctacttttagttctttaagaaatctcgtagagaacatttttaaaggaagtagtcctgaatgtgtactcttaacgatttatagtcactgccacctttcccaggctacttgtggttctcatcggagaaataggtagaatcatttgctagaaaggcggtattaggcattaaagctacatacctttatattgtaaaactagaggtctttatgattttaagaaagtattaattatttttcttctgcttttctctttataaaatagaatcagtaatacctgttgcttgtaacataccgtggtggtttattgattgaatttcttgaaaacatcttctgaagacttcattgtatgccttttgcaattctgattgcttaggttctgcccttttctaccaaaactacatttgtccatgtcttggcaataataatagcagcaacattaataatggattatgcaacgcttatcactttacccagtttatttaacttaattttcacaataatcctaccaggtaataactgttattttccctaattatacatgaagaaactaaggcctacaaaagataaataatgtatcaaaaaccaaacagtaaaatatagtttgtactccttaggtctttatatgtgatcttctctgtacctgtaactgtcataacccaccctcttcacttgcctagctcctatcatttagcaagcctcagagtagacatcatgttttctttttattattattattatgcttttaagttctagggtacatgtgcacaacgtgcaggtttcttacatatgaatacatgtgccatgttggtgtgctgcacccattaactcatcatttacgttaggtatttctcctaatgctatctctcccccctacccccaccccacaacaggccccagtatgtgatgctccccaccctgtgtccaagtgttctcattgttcaattcccacctatgagtgagaacatgcggtgtttggttttctgtccttgcaatagtttgctcacaatgatggtttccagcttcatccatgtccctacaaaggacgtgaactcatccttttttatggctgcatagtattccgtggggtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctggatcaaatggtatttctagttctagatccttgaggaattgccacactgtcttccacaatggttgaactaatttacagtcccaccaacagtgtaaaagtgttcctatttctccacatcctctccagcacctgttgtttcctgactttttaatgattgccattctaactggtgtgagatggtatcttattttggttttgatttgcatttctctgatggccagtgatgagcatttttcatgtgtctgttggctgcataaatgtcttcttttgaaaagtgtctgttcatatccttcacccactttttgatggggttatttgattttttgttgtaaatttgtttaagttctttgtagattctggatattagccctttgtcagatagatagattgcaaaaatgttctcccattctgtaggttgcctcttcactctgatggtagtttcttttgctgtgcagaagctctttagtttaattagatcccatttgtctattttcgcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattatataggaaatcctttccccattgcttgtttttgtcaggtttgtcaaagatcagatggttgtagatacgcggcattatttctgagggctctattctgttccattgttctatatctctgttttggtaccagtaccatgctgttttggttactgtagccgtgtagtatagtttgaagtcaggtagcgtgatgcctccagctttgttctttttgcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctatctgtgagcatggaatattcttccatttctttgtgtcctcttttctttcattgagcagtcgtctgtagttctccttaaagaggtccttcccatcccttgtaagttggattcctaggtattttattctctttgaagcaattgtgaatgggagttcactcatgatttggctctctgtttgtctgttattggtgaataggaatgcttgtgatttttacacattgattttgtatcctgagattttactgaagttgcttatcagcttaaggagattttgggctgagacgatgggattttctaaatataaaatcatggtagacgtgttttctaggaagccttccctgagcctgtcagaagaccaagttaagtctcatttgtgtgtgctcctatcacatcacttaacatattttattctaattacttatataactacctctgggtcctgaggacagagatcatcgccatcatgttcattgatttatccctagaacatagcactgccgtatataaaatgtattattgtagtccttcactgacaagtgattgaatgtgcccctgagaaggggtgtaaatttggatgaagaagcacatacagccagccagggtaaatttcagagaggaatgcaataatggagtcatcagcatgcaacttgcatggcagctgggaagtgaatattttcatcataaaggagaatcttggtggcacaccacagcatcaactacactaatcataacctctaaatatcacatgatagcatccagcttcaagccttcctattccttatctttacacagttttcagatttaggaggtgccagcttataaaagtcacaggttattgtgtcttaaaaatcacaaattctatcataacaaagaacatgagccttatttttctaggaaattttatggccacctagccttagttgtatctctcctatttgttctttaattcatttaacttatggtttgtgtatgtgtgtatgtgttttaataatttatggagataaattcacataacataaaattaaccatttaaggtgaacatttagtggcatttagtacatttacaatattgagcaactaccacctctgtctagttccaaaacattttcttcaccccaaagtaaaatccgttgcctggtaggcagtttgtctctatctttctccctctttccagttcctagcaaccaccaatctgcctctaaattcaccaatctggatttatcatgtctgtatgaatttatgtattctggagattttatataaatagaatcatatgatatgtgaccttttatatctggcctctttcacttagcatactgttttgtatattcatccaaattgtagcatatatcagtatttcaatctttttatagccgaataatattccactgtgtgtatgtaagtgatctatgatttataatgggtcaatttaagatttttcaactttatgatgatgcaaaaataataatgcattcagtagaaactgtactttgcatacctgtacagccattccggttttcactttcagtacagtattcaataactacatgagatattcagtgttttggtataagctaggctttctgttagatgattttgcccaaccaaggccaatgtaagtgttctgaacacatttaagataggctaggttaagctatgatgtttgattggttaagtgtattaaatacattcttgacttatgatgcattcaacttacaatgagtttgtcaggatggaaccccattatgagttgaggatcatctgtacactacaatttgtctatccatttatccactgatggacatttgagctgtttctgctttttggctactgtgaataatgttgctatggatattgctgtacaagtacctgttttcacatatttgggtatacacctagaagtagaattacagggtcatatggcaattttatgttcagctttttgagaaactgccaaactcttttcaaccataaaatggctgaaccattttgtattcccaccagcaatgtttgagggttcgtttctccacattcttactaatactcacttttctttctttcttttgttttgtttgtttgttttttggtaagctaacacatcatcctactgggtgtgaggtggtacatcattgtggttttcacttacatctctataatgattaatgaacttgagcagctttttgtgtgcttgttggctgtttgtgtattttctttggagaaaagcttatttgtcttttgccccccccatccccaccccacgcttttttgagacagagtcttgctttgtcacccaggttggagtgcagtggtatgatctcagcccactgtaacctctgcctcctgggttcaacccattttcctgcctcatcctcccaagtacctgggatgacaggcatctgccactgtgccctgccaatttttgtatttttagtagagatggagtttccccaggttggccaggctggcctcgaacttctaacctcaagcgatccaccagccttagcctcccaaagttctgggattaccagtgtgagccaccgcacctggccttttggctgttttttaattgagttgcttgacttcttgttgatgagttgtaagagttctttatttattctagatgctatatccttatcagatatatgatttagaaatttttttataatggaatttttttgtttatggtatgaggtaaaggtccaatttcattttttaacatatgggtttccggttgtgctgtcatcatttactaaagatactagtctttccccattgaatgatcctgtcaccctcatcaaaaattgacagagacttttgatggctgtgtgtggtcaaaaattaacagaattttgatggctcatgcttgtaatcctaacattttgagaggccaaagcgggaggatcgcttgaagccaggagtttaagatcagcctaggcaacatagtgagaccttgtctcaacaacaacaacacaatttttttaattagcagggcatggtggcatgcacctatggtcctagcttctcttgaggctgaagcaggaggatcagttaagcccaggagttcaaggctgcattgcgctatgatcatgtcacttcacctccatcctcgtcaacagagcaaaaccctgtctcaaataaataaatgagtaataaaaaacacagacttttgaatgtctagtgtatgccatcaaaggtcttttacactggagaaacaaaatgaaataatttctaatattattctagtatatgtcctgtaagaagttcagcatccaatcaaagaaacagacttgctatttaactattagaatgcagtgtgaagaatgctatgatagacaaatacagcatagttaggcttacagaagaaacacatccaaatcaagataaatatattccatatacataggagatcttaggcacaggcacataagcaaaaagataaattaatgcaaagttcacataggtacaaaatagtcaatcattcatttctctttttaaaagaaaaaaaagagaaatgaatgattgagtctatcggtggggtttcagagaaggtttcacagagtgcatggcttctgaacttgtttccacagagtatgggtgcctgcagagtagagggagcattccgaagaaggaagcagtagatccagaggctagaagtatgaaagtgtggcatgttttatctggcacataatgtcatgcttggcacataacagataccaaataaaggctaacttaattaatgacagagtgatgattaagtagggccaactaatcaagagactgaatgtgaatgtttatgaaagatattcattcaaataaaaacagaaaattttagatctgttgtagcttagttctgatgattaatcttgacagacgtataaataggactttaatataattctgtttctgaataggtaatatagatgaaattcaaaagatataatgaagagtaatgtgtttacttccctgaccaatattaaatggcaacctttataatgattttcattcattcctctgggtacattactcaaattttgtctttaattgtgatgtgcttctatgtgtatgttgtagggagtggggagtagggaagttaagtgtagagaatcatcagattttaaaacttgaagatcttctgttcctaaaaccttaatttttttttattccaaaggaatatatcatggtttaattaaggcagcagaaccaatagagtattacagagtaagagattcattttaggcataaaatcttacccagttgtagaaaaagctgagaagtaaaggtccagaagagggagttgaaggatcaaagtcacaaccaaccctcctgaagcacttgacctggttaaaaactttggagctttcaagaacctgggaaacatccggcagcacatccaactggtggactgaaaccaccagagagctgatagacattaatgggaggctgtggcctctgcatctggggtaaggccgggaggctggagttgctgttgttcagcagggtcaagagtcaggaagaagaagtgatcacagagacaggaaaagtgagaacaagccagaatctgccagcacctttccattggtctttcactgcatttaaaacatgaagacttgcaaagaatattggctattatttccctccatcttccaaatgttgttaaggttcctcttttgcaaaactctaaactctgaattattcttaggaagttgttataaaacaaaaactacagtaaactaaatttgaagtggttctttggcttgtccagtgtcacaaaaaatagagctatgtgtagaaccttggtttccttcctcttactagtcaactacttttcttctgctcaaggctcagacctcgtaggcttgtgctaaagtccattgttagctaatcactttctttttctttttctcttagcaacatttttgctacatctgggtttattttataatctgaggaaatgtactgatgtctgccatgtgcagtttgcacattcaagtgacttgctgctttatatggatactagtgctttagggggaggtggaaagtttatcttatgattacctgaaagtaccactaagtcttaattctccaagttaatattgatataattttctcatgtataatatttaaagatataattctaatagactttgcaaaagtacacttaaaagtaaataattttgttttgatcataatacttttatttcttcctatctctgacttgattttgttaggtaatttatcttttaaacttcattgtcagagaaatagttacagcatatttgtttgttaaaatatttttatatacacataataaattacatgtaatactctgtgggcttttttttttttacacataaagaattttaaaaattgttgttactatgtttgcttagcaagctgactttgaatctgacatgacatattcctaaagttcatcagtcttatacttctcaggattggtaacattgaatatggggaactatggctatgtgtaggcattaaaattcctaaaccatatatttctagctttatttctgagagattacgactattctctgtgtccttagatctcttttatttttatttttgagactattccccaaatgttcacaccgcacaggacccccagcatagtttgattagtgattaatcaaacatgagattttttccagaattgcatctggaattgtagataggaatatggaaagaaagaagttttctttgttttaaattttcaacctgaaaaacatcacttttatcttactaatttgtgaggacgtcaagctaagacctaagcaaaatttgggcacagtggctcatgctgggcacagtggtctctcactactttgggaggccaaatctaattctcatactttgtaggttaatgcctagattgacctaaacctacttgaatgatatgattttataatttccttaaaccttaccatgcctttacatgaaaaatgtgaatttttcttcctgcctaaaaagttcctggaaagtgagtgggaaggcaaaaggattcatgttacaacaggaggcagcagttggtttttcatgcttagcagccagcagatatcttcttccttacatgttggctgagagtgtcctgtggcaatataaaaagatggtgtagatataacagggcagagatcctgtcttgcctggtcttactcttctttatatcttagtgtagttactgactgatatagtaggcactaaaaaataagaaaatgtttaaattgtatataattatcatggtagcatacgataaaattttaaaatcttctgtattttcaattactttacagtcatcttacagctaagatggatggatagataatgccttgattcattgaaacccaactgaccaaagccctaaatagccagtttccctcctatggtgttttcttcttctttttttttttttgagatggagtctcactctgtcactcaggctggagtgtagtggtgcagtctcagctcactgcagtctccgcctcctgggttcaagcaattctcctgcctctcagcctcctgagtagctggaattacaggcatgtgccgccacgcccagctgatttttgtatttttagtagagacggggttccaccatgttggccaggctggtcttgaactcctgacctcaggtgatccaccagccttggcctcccaaagtagtgagaggccactgtgcccagcgtgagccactgtgcccagccatggtgttttctttttaagagaaggggccaaacaggattatatcaagaatgtattttaaaagcatttgtacaacatgtaacttttatacattatcctgtataattctgtgagcactataactggtacaacagtacatactattgaagtttactggtttatttatgaatgacagggtctcactgtgtcacttatagttcactgtgttgtgatcatagttcactgtaacctccaactcctgggctctaacgatcctcctgcctcatcctcccaaagcactggattataggtgtgagccactgtacccagccatattattgaagctttaaaaatgaaatttaaaaaatctcctgaccttctctcccttagtatattcctatctaaatcctcaacacagtttctaatgttctcttctctgagaaacattcagcaatacccctagtcgctccctcttccatgaagtttttttttaagcttttcctttgaaaagttctaacaagtaaaattagatgaccagcagttccaggttatagatataaacaactggaatcagagctattatccattggacatctcagtaaaattgaattaagttaatattttaatttagtatgctcataaaactgtcttctagatattgtaataaatagacgtagcacttgtgatctccattacaaatatattaacctttgttttgttcttttgttttggcaggaaagtttttgttggtgttttttttttttcaagaatgagaatattttattttaacattatttaattttgccgaactaaatttatactgatactttctttaaatgtaccttaaaaatcatcatttcaagctgtagttcttgtagcattgtgcacaagatgctttatatgtctttatagattctttgtgtatgttcagcaccttgagataaaagattaggtcccctattgagtatttccacacctctctgtactttccttattattatacttatcataccttatgattactttgtttagttatctttcctgctaaactgaattccgtgagaaacaacattatgtatccatttttgccattgttgtttcagcacctagcaaaggacctggcaccatagggagccctcaatccatgtttctcaatttcagagtaataaatgctatgaaaataatataactgggtaatataataagagtaattgggaaatttccttagattggagctcagggaaggccccttctaatacctgaatgacaaaaatgagctatctgttcaaatacacctggagtgtttctgctgagagtgttttaggaagagcaaagacactcgagtaggaacaagttgagcacgtttaagggttcatgcctggctgggaggaaagaagtaatagcagaggagttttagggagaaaagggctaaataatgaacggttttgtaagtcagagagagtttgaattttattttaattgcatttgaaagtcattggatagtgctcttgttgaaaaaaaagcctctaaatggatatataccgataactattattattattattattattatttttttttgagacggagtcttgctctgtcacccaggctggagtgcagtggtgcaatctcgtctcactgcagcctctgcctcccgggttcaagcgattctcttgcctcagcctccgaagtagctgggactacaggcccacgccaccacgcctggctaacttttgtattttttgtagagatggggttttaccatgttggccagactgatcttgaactccaggcctcaggcaatccacccacctcggcctcccaaagtgctagtattacaggtatgagtcaccatgcctggccaactatttcattttttaagttcctataggatttaaattatttatctttatgcctcccattaatataaacagaagaatatctaggaataggtttatgtaacacatagttttccaggtagcagattgtttataataaatgtttgggaatgttactgttttcatatttaggaataactactgtaagagatggtctcaggtgataaccacaagtttttttttgtttttttgttttttttttttgagatggagtcttgctctatcgcccaggctggagtgcagtggcgcaattttggctcactgcaagctctgtctcccgggttcacgccattctcctgcctcagcctcccgagtagctggggctacaggcgcccgccaccacgcccggctaattttttttgttgttgttgtatttttagtagagacggggtctcaccatgttagccaggatggtctcgatctcctgacctcgtgatccgcctgcctcggcctcccaaagtgctgggattacaggtgtgagccaccacgcctggccgattaccacaagttttaagtatcttctgctctagcatcttccatctaaagttcagccataatgacatactaagaaaatctttatgttgcataagaattgctctgtgcaccagcctgggcagcatggcgaaaccccgtctctacaaaaaatacaaaaattagccgggtgtgcagtccacacacttatagccctaactacttaggaggctgaggtactgggatgacttgagcccaggaggcagaggttgcagtgagccaagatcatgccactccactctagcctgggtgacaaagacagagggagaccctttctcatacacaaaagggaaaaaaaaaaaaagaaaaaagaattgctctgtgcacacagaccatctagcatttcttattctgacttttttggtggaatattttgggaaccttggtaccacttttcctacttctggtctttcataatatgcagtttttgaagtgtgattcttaaactcctttagtatttcccacaaaggcataccaaaatgtatgacagatgggcagaagaaccttagtgtaaatattctgagtccaagaaagatgaccacagcctttctgacacatgtgttttcttgagtgcatgtggcatacacctgtgccttcttgcttagtaacaatttcagagaactatactttttttttgtttacaatctatacctcccaaagcttactagaacagcttttgccaactcacatgattatttttctgttatttgcttagaaccttaaaatagtcaatgttttgttattttcatcgagggtttaataaatttctatggacataatcctctatattactacatgataggtacagataattataccatttctttgtttatgtggacaatatagacatacattaaaccattgttttattggagtacatcagcgaattattgattctacagctcctataaccctatgtgccttggaatgctgtaatctgttttctccagctgaatttaatatcttttcatcatcatgggtgatgagcagtttcaccaagatatgtctgcttgtggatttccttgtatttgtctgaaccaggacacactgtgcttcctgagtctatgaattcttatatttcatcatttctgggaaaatcctcagctattttttctttagtattttctcttttcctttctttctgttctctcattttggaattctagttatatatgttggactcatctctccatgtctcttcgttttccttttaaactttgcattttaaaatttattttagtacattctggaattttctcaaatctatattctagtcttaagatatatctaaatgctatttatcccacctattatgtctttaactttagtaactgtattttttatttttggaaattctctttggttgtttttgaaacctgatttgcccttttgaatagtgccttgctttttttcttatgtttttttaattctgtatgtttttagtaattttaagcaaaatttttattgtaatttagtatctattaaaattttattatcaaaagttcttgataatgcttttgaaaatgggatctaattttcctcttgctaataaggatttttatgtatatataaaatagtctgtattagaagcttatcttcaatgatctttttcccttgagtatcctttttgtcattgaggacatgttttctagagaggttttgcatctgtttctgacagatgccccagggttatcaaaattctggtgctactgctgtataaataacagaaggggtatttgaggaccacccaggtaatataagttagagccacttaatacatgtaggatatttctcattatttttaattttccagggagatatttgttttttcaacaagctctcttgccaagacaggcaaactttcttattctttcctgtttctgatgggttgatgtttttctggcccttcaggggccccagatctaggtaggcagctcatttaaaaatccttgccttatctcaaatacctgttaaactctgttcccttgattcattaagagtgctgaccctctcaatttaatgaccctaaggtcattaacaacctcagttaatactttgtgttttagttccttcttttgaattttgaaacttagactgttatatggtaaaatattgacagaatttaattcttaattgtagttattcagtgtttcttttctgtttttcttttgaatttattcctgaaaatatttgaatctgtaaagattttcaatgatttttaaaaatatttaccattacctcaaatatttaccagagatatcataaaacttaatactatataccagaaaaataatagttttataagactactgacttatttatattttgttactacttctaaggtcaaaggtctttcatattttgtgttactgatttaatttatcacatgatggagagaaatgtataatatggacaagtaccctttttttcattgcccttggttgttagtgtttgctcttatttggttccctgccaacttttccattttaaggtatttttaatacatcatatattttagcactcccctatgagagcacatcagatgttatatgtttctcacattggtcattttatggaatttgagctattaggctataattatgatgtctctcaggatctcaacccttcctctgtagtcacagattttaatacttcttccggttactctctactcaccagatctcttaattctttagaattgactttcttgaaatccaatacttatgtgtcatagaaccagatgatccaatttgcttttttggcagacaccatatagagctctgctcattgcaagtttaacaaaagaccagagtattctctggactactctgataaaaacaaaaaatggtgtagaaagacttgaattttaactaggctttttcatgagataatttatgccaattctctgatttgaactttatcattttatgatataagggaataataagggcatatttaaaaggaatattaagttaatagcttgaagggaaatttgaggtatggcttgctaacgaaacataaatgtattattagttgataaaatgaaaactaagaatatacgcagtggacttgaagatctataccagcacaaactttgctttctcaataatgttttccagtttcatcttttaccatgtacttcctttgaaattaataatttttttattattatactttaagttctagggtagatgtgcacaacgtgcaggtttgttacatatgtatacatgtgccatgttggtttgctgcacccattaactcatcatttacattgggtatatctcctaatgctttccctccccccaccccacaacaggccctgctgtgtgatgttccccaccctgtgtccaagtgttctcattgttcaattcccacctatgagtgagaacattcggtgtttggttttttgttcttgcaatagtttgctgagaatgatggtttccagcttcatccatgtccctacaaaggacgtgaactcatcatttttatggctgcatagtattccatggtgtatatgtgccacattttcttaatctagtctatcattgatggatatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactaatttacagtcccaccaacagtgtaaaagtgttcctatttctccacatcctctccagcacctgttgtttcctgactttttaatgattgccattctaactggtgtgagatggtatctcattgtggttttgttttgcatttctctgatgaccagtgatgatgagcattttttcacatgttttttggctgcataaatgtcttcttttgagaagtgtctgttcatatcttttgcccactttttgatggggttgcttttttcttgtaaatttgtttgagttctttgtagattctgcatattagccctttgtcagatgagtagcttgcaaaaattttctcccattctgtaggttgcctgttcactctgatagtagtttcttttgcagtgcagaagctctttagtttaattagatcccatttgtcaattttggcttttgttgccattgcttttgttgttttagacatgaagtccttgcccatgcctatgtcctgaaaggtattgcctaggttttcttctagggtttttatggttttaggtctaacatttaagtctttaatccatcttgaattaatttttgtataaggtgtaaggaagggattgagtttcagctttctacatatggctagccagttttcccagcaccatttattaaaaagggaatactttccccatttcttgtttttgtcaggtttgtcaaagatcagatggttgtagatacactgcattatttctgagggctctgttctgttccattggtctatatctctgttttggtaccagtaccatgctgttttggttactatagccttgtagtatagtttgaagtcaggtagcgtgatgcctccagctttgttctttttgcttaggattgtcttggcaatgagggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgtccttccatttgtttatatcctcttttctttcgttgagcagtggtttgtagttctccttgaagaggtccttcccatcccttgtaagttgtattcctaggtatttttttctctttgaagcaattgtgaatgggagttcactcatgatttggctctctgtttgtctgttatttgtggataagaatgcttgtgatttttgcacattgattttgtatcctgagactttgctgaagttgcttatcagcttaaggaaattttgggctgagaggatggggttttctaaatatacaatcatgtcgtctgcaaacggggacaatatgacttcctcttttcctaattgaatatcctttatttctttctcctgcctgattgccctggccagaacttccaacactatgttgaataggagtggtgagagagggcattccctgtcttgtgccagttttcaaagggaatgcttccagtttttgcccattcagtatgatattggcttgggtttgtcataaatagcccttattattttgagaaatgtcccatcaatacctaatttattgagagtttttagcatgaagcgttgttgaattttgtcaaaggccttttctgcatctattgagataatcacgtggtctttgtctttggttctgtttatatgctggattgtgaaattattaataattttaaatttcaggtaaaaatattctgctaaataactgatgaaagctgggaatacataaagaagaactaaaatagaggccaaaagctgttttggtgtcaacttgccctccaggtccaattctggaacctttgttctcattgtgtagccttagcccagtacttgaacttcatttccttacagataataatggggctattaacagtccctactttacatacaggattgttttcaggaagcatttaatatctcacacaaaaaccttaacagctggacatggtggctcaacacttgtaatcccagcactttgagagtcctaggcaggagaattgcttgagcctaggagttcaagaccagcctgggcaacgtgaggagactctgtctctagaaaaaataaaaataaattagccaggcatggtggtacattcctgtggtcccagctactcaggaggccaaggtgggaggatcacttgcgcccaggagattgaggctacagtgagccatgattgcaccactgcactccagcctaggtgacagagcaagaccttgtcttaaaaaaaaatgaattaacattgttcttagaccttaaaaagaaaagaattcaaagactaaaaggatatgcttatgaccctaatgaggtcagcaagacagcagttatcaaatagaaggtcagatattaaaaataggaaatgaaaaattattccaaaaaatagtaagattattggtggtaacaaaagtgatatgaaactatttgcaagaacaaaaaggagtaaaaatttaaaaattaatttgttaaaaagtcctgggatgatactaatatgaaattgcttaattacaccttaatttctcaagatgttttcatcttttgtaaatcttatggaattgaagttaagaaacgatgactgtaaaatatgcaaataggcactctcaaaataataatgtaattttgccatacatgtttgtagtacaaagacttgtacaaatttaatgaaaattgtctttgaaaataatgaaatggctaataatcttttactctatcttttagcatacggcggcatcaagaaaggagagcaattttgacccccgttttgacagatttttctgtccgaataactggagcacctgctgtcattttcaccaaagtagtttctccagaaaatttgcatactgaggttagaacataattttgattttattttagtctaaataatggaattgctcctctttgtatgttagggattgccacagtttcagcccataggacttcaaattagctcattaataataatggctactatcatagctaacatttatggagcactttgtagtactcttcagttattgctttccttgtaataactcatttagtcctcataataatcttatttgctactcctcatatccgtattttgtagatgacaaaactgaggcatagaggagctaaccaagctacccagattgttatgcataccttagttgcctcatatatagctactcttgttgccctctagattgtcataaggttcaaactgatcaatagaagaaataattataagaggaatctgagaagctaaagttctataaaaatgaaaattatccttgtttttatattattagctgctaatcctaccaattgcattcatactatttaacctactagtataagatcaattatttgcaagttttcacaggatgtatgccaccaataaagccaagttatttttagtacaaatttttgtgctcttgggtaatgttacggtgactatttttttttaatcctgaattggtatacttttttccctttttgtcaatacttgaggaatagaataagaattctaactagagtgaatgaatacagagaacttgtggaggaaaaaattgtttaaccaaaaaaaaaaggataattatttcagacatgctgttcttcatggctttattaaaagctgctctaagctgtctcatttgcatttggactagtcatagtctccttaaatccattcctctggatgatactataaggggaagatctgttggacatttccaagcatttgaacattgtccacatgcacatcatgacaagaggcaggacttattaagtgaaactattgtattggttttttgttttgttctgttttccttgtctgaacggttttccagtgataaatgttcaagtgactaggttttgcagaacagcaccaattaagttatggacatctacccaatgctgccaagattttagcagtttaaagaagtgaaattaattagtctagctgtctttagcttcaacactccgttttcttataaatcatttagagtatatcctttggagaatattcatactgtggctcttagcaattaattgcctgcctaaaattgtctgtttacatctgtctgcccaactagattataacctcctcaagagcaggttgcccttcaaggccgacattattctttgtgatattcataggactctactatcgtacctagtacttaggaaatgctcagtaaatattagttggtttgaattcatgaacaagattatgctacacaattatattgttgctacatattgaaaacaataataatagttggagttatggaaaagtcaaataggtatgaaaaggtgaagacttcttattgttagttgtgtatatctagcacaaggcccaacacacagcaggccctcataaatatgaaattcatctgttaaattgtgtcaagtggctgtgctcaccatttttgctcttctccttaatgtatgaacttgagtcctaggaaatgtcaccaaagtagtgaaggtcaaataagtaagaatgataaattatcatctgaaagctatcatgtttctttatctgtattctaccgtttttgcttcaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgatattctttattttagaaatttgtttggtctctattcctcttatttatcatgtacctttgcaaaattgctgtggactgacctcagaggaacctctgttatatacataactttattagcctgctgaagttctaaagtatgatgcgagaatcctggtatagctttcatttactcggatacattacagtaataaggcctcttttggaagtgaactttctaagagtactatgggaatatcttcaataaataacttgtaaagcatttgtttcccatgctcagtgggaaatgaatggacacaatcataaaagttgaatgcctgcctagaattttaattttgatacagtgttcattggaagcctgtattgtaaccacaaagtatgtcagcaagaaacaaagaaagctatttgttagattcttctcaagatatattttctttgcattttgtttccacatttctctaacattctgtacttagaataaatattttataaaaactcaggtgaacaaactgtttatatatgaaaaagatgttgcttttatttttgtcatgagttgtaaagaaagctttaagttctgtttagtaagaaggtaggaaatgaagaggaatttaggtctcaagtcagcactgtttccattctgccacagattatgtattataactgtgacattattctttcagtcttctttatttttaaaaaaattattttaaaatgataaatcttttatcttttgtaaatgattttctaatgtaatcatcctttactagccatgatatctatttattcaatatctattgtaaaaggactttagaactacatattgtccaaaatattgagtttttaaatatacattagggaatccataaaaatgtaattatatgacatcaaaataagcaaattaaaaaatatttccccatgcattttcgatgaggcctctgaagcaagttgagttggataaaagtaaattacattcctatattatttgtgccaattttataaatgtctcctgtcaaagaaatctaactctcagatcactgattgttttaggattcacataacttagcaaattggttattaactatttatctacatacttttaatgcctcttagggggatcaatttcagtaaataaagggatactcggagttactaactatccttccctgaatgttgaatcattactgacaattccgtaaactatataggcattgttttcttctgctttaaaaaggtatctgtggctatgtgtttcttcttagagatcatattacaagtacagatgacatgaacatttttaaatggttaaaatggtaaattttatgttatgtatatatatcacaattaaaaaatacaggctatataatgagaaaggactgtttggaccttttcccaaccctggtgggacatatctgtaaaactttccgtattttagaaaagacctacagtgcactggaagaatatgattcaatttttaaattattagcagaactcatatctgctagtctatgaatataaagacattttagttacatagaatactccataataagtcaaaggtatattttgaaagggctagttgattgcctttagtgtggtttcacaacaacactaccagaatttttttttctttttttttgagatggagtcttgcactgtcgcctgggctggagtgcagtagtgcgatctcagcccactgtaacttccacctctcaggttcaaacaattctcctgcctcagtatcccacgtagctgggattacaggtgcctgccaccatgcccagctaatttttttgtatttttagtagagacggggtttcaccatgttggccaggctggtctccaactcgtgacctcgtgatctgccctccttggcctcccaaagtgctgggattacaggcgtgagccaccgcgcctggcctttctttctttctttcttttttttttaacacggagtctcactctgttgcccagactagagtgccatctcagctcactgcaatctccacctcctgggttcaagcaattctcctgcctcagcgtcccgggttgctgggattacaggtgcatgtcaccatacccagctaatttttgtatttttagtagagacgtgatttcacaatgtcagccaggcttgtcttgaactcccgacctcaggtgatctggccccctcagcctcccaaagtgctgagattacaggcgtgagctactgtgcctagccaacaatttttttaaaaattccttttgagaacaaaagaaaaataggaaaattaaacctggctaagttattgggaaaatggaggaagatatacatgttagtatatataatataatcctgatattataaacaactactatttcataggaattatggattaataataagaatcccatttatcaggttttctagaaggcaccctgtgaattatagaccagtaaatgtcaaatctgttctaagtccaccatctgatactatgttgatgcaacatagttctataagaagaaattatgtatatttaattatgtataattaatatatataacattaaatatatatatatatatttcttttcttttcttttcttttcttttgtttagtagagatgaggtttcaccatattgcccaggctggtgttgaactcctggcctcaagggatccatctgccttggcctcccaaactgctgggattacaggtgtgagccaccacacctggcctaatgtagtatattttttgaaggtgttaacattttcagacaacctttggcaatatttatttgaaagattaattttggctgggtgcctagtggctcacacctgtaagtccaacactgggaggctgaggtgggcggattgcttgagcccaggagttcacaatcagcctgggcaggatagtgagtccccatttcaacaaaaaaaaattaaaaattagttgcatgtggtggtgtgtgcctgtagtcccagctactcgggaggctgaggtgggaggatcacttgagccccagaggtcaaggctgaagtgaggtgtgatggtgccactccactccagcatgggtgatagagcaagagaccctgtctcaaaaaaataaaaggaagattaaaaattattcaagaataatatcacttgggaggccaaggtgcgggcagatcacttgagcttaggagttcaagaccagcctgggcaacatggcaaaactgcatctctacaaaacacacacacacacacacacacacacacacacacacacacacacacaaattaggcaggcatggtggcatgtgcctttagtctctgctacttgcagggctgaggcaggaggatcacttgaacctgggaggtcgaggctgcagtgagccaagatcacaccattgcactccaaccaggtaacaaagtgagaccctgtctcaaaaaaaaaaaagtataatatgatagggggattatgtattagtggaggaaacatctattcaataaacaaaggggaaaaatgcacatatctttgaaactagaagtgaaaaccgtaaagtaatctgaggattcttgccagaaccaatatttaatattaattttaattaaaaagacaactaacacataatgaaatttaccagttcacagccaaaatgactggatgatggattaggaaaattgtctcccacattaaacaaaaattttccaatatttttgctctgaaaaatgtgttttagatggggtgaggccactagaccaatgggcctgtattcatactattagattttcactgtccccttcaagtactataatttccatgatttctagctcccagaatatttggtttctgcctttaaatgaaccttatttctctatacatacaggttgagtcccctatctgaaaactcaaaatttgaaatgcttccctgagcattttctttgagagtcatgtcacgttaatactaaaaaaatttcagattttggagcattttggattttgaattttccaattaaggatactcaacctgcgttatgacaggctgagaaattacataaaagaaacaaatttaatattcaaaaatcaaaatgcattccatattacaaagtacatttccttccttatctagctcgctgcgatagttcaccatcccattctatatttcatgtttccgtgacatctggctctagaggactagtacaacaggcacgttatttgggattcttacatgttagttccttgccttttacatgaggtgagagtcaaccttttggataccttaacagccaaagccaaatttacaattctaagtttactcccaaaacagagctccactactcagccttgatttcttaaccagtgtttaacaggactgtggttgacacaattggtttacccttcagaaggttctttaccttcttacaagatagtcttagtctcataaaggcccaattatataatcatgggcattagtttatttattataatatggttttatttttatcaaattagtaagtgaattttaacaaccaaattttgctaatgaaatacatcaaagtagcatcaatccctgataccctcacctcattctgcccaacagtcagccactctttataagctgtttcttcaagtatttatttccatatttctaaataacctgaatggcctatcatatcttgattccctattaccgtattcacttgctatttgttgttaataagggttctatctcttctgcacttcctttctacacttccatcttcccagtattcttatatcatattcttttttgtcaatcttaattgtcttcattataaagatgatataaatattgttcattgcttagtgaattaatgtagtgtgataatatttcttgtcattttactattgaagttactcattgccacattttcttttttttcttttttctttttttgagatggagtctcgctctgtctcccaggcaggagtgcagtggcgcaatctcggctcactgcaagctccgcctcctgtgttcacgccattctcctgcctcagcctcccgagtagctgggactagaggcgcccgccaccacgcccggctaattttttgtatttttaggagagacggggtttcaccgtgttagccaggatggtctcgatctcctgacctggtgatccgcctgccttggcctcccaaagttctgggattacaggcgtgagccactgcgcctggccactcattgctacattttctatttactcagttttttaaaaatctctgtcttccctctcactaacgcacaccccattcccatcagtggctctaccataattcctcgcaatttaatttttcacactgtaaaacttatcgaatagcatcacctctgcttttccccccagagccatttttcctgaagttctttttctgccttctctgttctgggactgttagttctctagacctgcggcacacttggcataaaacagccagatgagagaagattgtgatttgaggttggtgtaaagaatgttagagaaaaatctagggaacaataaaataatgtgttcttctattaatataaattagtaaattgaccaatatctttattctttcattctaaaatattaagtattattatttactacattaaaaagtataatagtatagaaaaatgttgtctggctaatatctacttggatatttaaagttttttatgaaatagaaaataatgcattgggcttttttgctatgaactgtcattgagcttatgccatgtgaagtgatggtagaggttgtttggggtggtattttactgttttaacttagaaataatcagttttgtagttgtgcttcattttaggcatagaaattcttgtcttttagtagaaagtgaaaaattctccaagacattcttgaccaaactaaggattgtcagaaataattagaaataggaacttgaaggtaaagaagaaggaaagggactttaattgtgtggttgcgtaataacagatgtcttctggaatagaatttcaggtaagatgagggatatagaggaaatgaataaccaaaatgcatgtgggtaaaggggggtttgagagaggaaactgagactggcatgaaggagtatgtcgattttctggtcggtcttgctgcttactctcttgaggtagtcatgaatggaaaaagccagatcagaggctacatatttctgtatttaggaaaggagatgggaattttggacgatatgcatagggtgacctcctattggtgttgctatgctgagtattttgtttcctttcagaggcacctggatagaccacttgtaaccaggcaataaacacagactccagtaaaatatggattcaagcagagccttaaaaggacaagaggggctgtgacggaatacctcaaatttcttaaaatctaggcctggaaaagatattaagtattttactgcctatcttctccaagggaaggatttcttaggtacattgaactctcacatctgtcacaattttagttaggccttgtcaacgttaaaattagtgtaattttctcctgataaacaagcttgtgctgagacaggaaaacaccacagttgcctcaaagtagatgtaagacatcaagaagacaataaaattttaaaattttcagcccccatgatgtttatccctatagatttctttgccagaaatccagtaaatgcgttaagttttcctcaggctccagtaaactgtctacgctagtcttattaggcattgttcattgagagcttactatatgccagatacactggctacagtctgacagaggtttgaaaaataagtacactatggtctctgccctctaggcttttataatctggttgggaagtaaagcatagacaaatggaatgataactaagaactcagagcagtatatgaaaagtgttaaatatactctatggaaaattagacttatgagtccagggaagaaagagaaggctttaggccaggtgatcaatgatctagcttcatggagaagtggaatacatagaaaagagtagcctatttatttattcaataaatattgaatgcctcctatgcgtcaaatactattatggatactagggtgacagcattaaacaaaagaggtaatatttctgctttcatgtctaatgcacatatatttagtagggaagacagacaataataaatatttggaactacctcaaaatataaatacacctactcgtgtgcagagattatatagctttacattttctgtaactgacttaatttttcttacaagcctaaacttcatttagattaaggatgttggttgttagagaagagaagcagtaagggagtatacattaaatttgccatcaataaaaaatagtttcaacatggagaaatagcatgaataaagacgtggaggtttctaagcattaggattttttggtaggacagtgaaaaaaattaatctttctagagtgaaggaactgtgcagggaaataatggaagatacactaagaagtgtatattttatcacgagcagttgggaaccaaagtttatagacttgaatgaatggtatgacatagaagaaatggtattttaatgaaatttgttatgcttagtcttttttggcaaaggatttgaagtggcattcaataaaacataaaaaatgaaaactgcagactaatacctctggagaatatggatgcaacaatcctcaacaaaatgctagcaaactgaatccagcaacatagaatgaattatacactatggccacatgggattacccagaaatgcaaggttggtttaatatctgaaaatcaattaacgtaaagcactatatcggtagaattttttaagtcatatgattatctcaataagtgaaaaaaatttttagacaaaatccaataccctttcataataaaaacatgcaaaaaactaggaatagaagggagcttactcaacttgataaatcacagttatgaaaaactcacaattatcatcatagttgatgataaaagactagatactttccccctgaaatcaacaataagacaagaatgtctgcttacatcacttctatttaacattgtactggaagttctagttggagtagttaatttcacccagtatgcttccaatcccttactatgtttaactttataagcaaaaactgatcatatggaggtcctcttacagaatgagagactcttagaactgtcaggtacttcagaaattgtgttatttaattgattcattatcattcattagcccacatgagagtgaaactctacttagcctcctgctgccctctgtgagccttcttgcactccccactcctcttttcagtggacacaaccagaaaacctcaagtatcctcagagtttgacagaaacgggagagggtataagcttgatgccatattaagctgttttccattggatgaggaaagcatagcttcctgtttgttaaaacaggatttctgttttcttaaaacagtataggttcctgattcttaaatttcttcctgataacttcttctcttaaatccacatgatttttctgatggaatccttgctagaaagccaagttaaggcctcagagctgttcatttatttgccatccacccttcagaaaattcttagactgggtcagtcagcagtctatatctatgcacttaactcactgtccagggcacccaatcatttatagaagaggaagattcaacatagtaatgtctaatacctgagtcatcccgtcttcccaactagtctagtccttcttaatgagtcttactgtctgtccccctatttttctgttatggcctgacttttaatataaggctgattctgaatcagattaatcaaatgcatgttaaatttgagtggtggttttgtggggagagggaaaagatgggccagtaaaccctaaaacacagagcaattattttgcacatctttgaaagtgctttacaacaaatgaagaaacagtctatgctcatggatgggaagaatcaatattgtgaaagtggccatactgtccaaagtaattaatagattgaatgctattcccattaaactaccattgacactcttcccagaattagaaaagaaaactattttttttatactttaagttctagggtacatgtgcacaacatgcaggtttcttacatatgtatacatgtgccgtgttggtttgctgcacgcattaactcgtcatttacgttaggtattactcctaatgctatccctcccccatccccccatgacaggccccggtgtgtgatgttccctgccctgtgtccaagtgttctcattgttcagttcccacctatgagtgagaacatgcagtgtttggttttctgtccttccaatagtttgctcagaatgatggtttccagcttcatccatgttgctacaaaggacatgaactcatcctttttcacagctgcatagtattccatggtgtatatatgccacattttcttaatccgatctatcactgatggacatttgggttggttccaagtctttgctattgtgaatagtgccacaataaacatatgtgtgcatgtgtctttatagcagcatgatttataatcctatgggtatatacccagtaatgggatggctgggtcaaatggtatttctagttctagatccttgaggaatcgccacactgtcttccacaatggttcaactagtttatactcccaccaacagtgtaaaagtgttcctatttctccacatcctccccagcacctgttgtttcctgacttttaaatgatctccattccaactggcatgagatggtatctcattgtggttttgatttgcatttctttgatgaccagtgatgatgagcattttttcatgtgtctgttggctgcataaatgtcttcttttaaagtgtctattcatatcctttgcccactttttgatgtggttgtttgattttttcttgtaaatttgtttaagttctttgtagattttggatattagccctttgtcagatgggtagattgcaaaaattttctcccattctgtaggttgcctgttcactctgatggtagtttcttttgctgtgcagaagccctttagtttaattagatcccatttgtctattctggcttttgttgtcattgcttttggtgttttagacatgaagtccttgcccatgcctatgtcctgaatggtaatgcctaggttttcttctagggttttcatggttttaggtctaacgtttaagtctttaatccatcttgaattaatttttgtataaggtgtaaggaagggatctagtttcagctttctacatatggttagccagttttcccagcaccatttattaaaaagggaatcctttccccatttcttgtttttgtcaggtttgtcaaagatcagatggttgtaggtgtgtggtgttatttctgagggctcttttctgttccattggactatctgttttggtaccagtaccatgctgttttggttactgtagccttgtagtatagtttgaagtcaggtagcacgatgcctccagctttgttctttttgcttaggattgtcttggcaatgagggctcttttttggttccatatgaactttaaagtagttttttccaattctgtgaagaaagtcattggtagcttgatggggatgtcattgaatctacaaattactttggacagtatggccattttcacaatattgattcttctatccatgagcatggaatgttcttccatttgtttgtgtcctcttttattttgcttagcagtggtttgtagttctgcttgaagaggtccttcagatcctttgtatgttgtattcctaggtattttattctctttgtagcaactgtgaatgggagttcactcatgatttggcactctgtttgttaatattgtataggaatgcttgtgatttttgcacattgattttgtatcctgagactttgctgaagttgcttatcagcttaaggagattttgggctgagacgatggggttttctaaatatacagtcatgtcatctgcaaacagggacaatttgacttcctcacttcctgattgaatgccctttatttctttctcttgcctgattgccttggccagaacttccaacactatgttgaataggagtggtgagagagggcatccttgtcttgtgctggttttcaaaggaaatgcttccagtttttgcccattcagtgtttatcataaatagctcttattattttgagatacattccatcaatacctagtttcttgagagtgtttagcatgaagggctgttgaattttgttgaagaccttttctgcatctatggagataatcatgtggtttttgtcattggttctgtttatgtgatggattatgtttattgatttgcatatgttgaaccagccttgcatcccagggatgaagcagacttgatcatggtggataaactttttgatgtgctgctggatttgattttccagtatttttttattattattatactttaagttttagggtacatgtgcacaacgtgcaggtttgttacatgtgtatatatgtgccatgttggtgtgctgcacccattaactcgtcatttagcattaggtatatctcctaatgctatccctccccgctcccccaaccccacaacagtccccagtgtgtgatgttccccttcctgtgtccatgtgttctcattgttcagttcccacctatgagtgagaacatgcggtgtttggttttttgtccttgcgatagttttctgagaatgatggtttccagtttcatccatgtccctacaaaggacatgaactcatctttttttatggctgcataggattccatggtgtatatgtgccacattttcttaatccagtctatcgtttttggacatttcggttggttccaagtctttgctattgcgaatagtgccgctataaacatacatgtgcctgtgtctttatagcagcatgatttataatcctttgggtatatacccagtaatgggatggctgggtcaaatggtattgaggattttcgcatcaatgttcatcagggatattggtctaatattctctttttttattgtgtctctgccaggctttggtatcaggatgatgttggcctcataaaatgagttagggaggattccctctttttctattgattggaatagtttcagaaggaatgttcccagctcctctttctacctctgatagaattcggctgtgaatccgtctggtcctggactttttttggttggtaggctattaattactgcctcaatttcagagcctgttattggtctattcagagattcagcttcttcctggtttagtcttggaagagtgtataagtccaggaatttatccatttcttctagatctcctagttcatttgcatagaggtgtttatagtatgctgtcatggtggtttctatttctgtgggatcagtggtgatatcacctttatcatttttttattgcatctatttgattcttctctcttttctttattagtcttgctagcagtctatcaattttgttgatcttttcaaaaaactagcttctggattcattgattttttgaagggttttttgtgtctctgtctctttcagttctgctctgatcttagttgtttcttgccttctggtagcttttgaatttgtttgctcttgcttctctaattcttttaattgtcatgttagggtgtcaattttagatctttcctgatttctcttgtgggcatttagtgctataaatttccgtctacacactgctttaaatgtgtcccagagattctggtacattgtgtctttgttctcattggtttcaaagaacatctttatttctgccttcatttcgttatttaccaagtagtcattcaggagcaagttgttcagtttccatgtagttctgtggttttgagtgagtttcttaatcctgagttctaatttgattgcactgtggtctgagaaacagtttgttgtgatttctgttcttttacatttgctgaggggtgctttacttccaattatgtggttaattttagaataagtgtgatgtgatgctgagaataatgtatattcggttgatttggggtgaggagttacgtagatgtctattaggtctgcttgttgcagagctgagttctggtcctggatatcctcgttaaccttctgtctcattgatctctctaatattgatagtggggtgttaaagtctcccattgttattgtgtgggagtctaagtctctttgtatgtctctgaggacttgctttatgaatctgggtgctcatgtgttgggtgtatatatatttagtatagttagctcttcttgttgaattgatccctttaccattatgtaatggccttctttgtctcttttgatctttgttggtttaaagtctgttttatcagagactaggattgcaaccgctccttttttttttttttttttttgctttccatttgcttggtagatcttcctccatccctttattttgagtctatgtgtgtctctgcatttgagatgggtctcctgatgaatccagcacattgacgggtcttgactctttatccaatttgccagtttgtgtcttttaattggggcatttagcccatttacatttaaggttaatattgttatgtgtgaatttgatcctgtcattatgatgtttactggttattttgcccgttaaatgatgcagtttcttcatagcatcgatggtctttactatttggcatgttttcatggtggctggtaccagttgttcctttccatgtttcgtgcttccttcaggagctcttgtcaggcagatgtggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctgacttgcagggtttctgccaagagatcagctgttagtctgatgggcttcgctttgtgggtaacccgacctttctttctggctgccctcagcattttttccttcatttcaaccttaatgaatctcacaattatgtttcttggggttgctcttctcgaggagtatctttgtggtgttctctatatttcctgaatttgaatgttggcctgccttgctaggttggggaagttctcctggataatatcctgaagagtgttttccagcttggttccattctcgtcattttcaggtacaccaatcaaacatagatttggtcttttcacgtagtcccatatttcttggaggcttttttcttttcttttctcttttttctctatcttcaatcactgataccttttcttccacttgattgaatcagctactgaagcttgtgcatgtgtcacgtagctctcatgccatggttttcagctccatcaggtcatttaaggtcttctctacactgtttattctagttagccattcatctaatcttttttcaaggtttttagcttccttgcgatgcattcgaacatcctcccgtagcttggagatgtttgtcattaccagctttctgaagcctacttctgtcagctcgtcaaagtcattctctgtcctgctttgttccattgctggtgaggagctacgatcctttggagtagaacgggcgctctggtttttagaaatttcagcttttctgctctggtttctccccatctttgtggttttatctacctttggtctttgatgctggcgacctacagatggggttttggtatggatgtcctttttgttgacgttgttgctattcctttctgtttgttagaaaaaaactttttaaaaattcaaatggaaccaaaacagagcctgaatagccaagataattctaagcaaaaagagcaaagctggaggcatcacactaccagacttcaaactatgctataaggctacagtaaccaaaacagcatggtactgatacaaaaacagatacatagaccaatgaaacagaatagagaactgagaaataagactgcacacctacaaccatctggtctttgacaaacctgacaacaacaagcaatagggaaaggactctctgtttaataaatggtgctgggagtgctggctagccatatgcagaaaattgaaactgtaccccttccttacaccatatgcaaaagttaactcaagatggattaaagactaaaatgtaaaaccccaaactgtaaaaaccctagaagaaaatctaggcagtaccattcaggacataggcatgggcaaagatttcatgacgaagatgccgaaagtaacccaacaaaagcaaaaattgacaaatgggatctaattaaactaaggaacttctgcacagcaatagaaactatcatcagagtgaacagacaacctacaaaatgggagaaaaattttgcaaactaaccatctgacaaaggtctaatatccagagtctacaaggaacttaaccaaatttacaagaaaaaaaacaaccccattaaaaagtgggccaaagacgtggacagatacttctcaaaataagacatacatgtggtcaaggaacatgaaaaaaagctcaggatcactgatcattagagaaaggcaaatcaaaaccacaatgagataccatctcacaccagtcagaatggctattcttaaaaagtcaaaaaacaacagatgcttgcaaggttatggagaaaaacggaatgcttttacactgttgagtgggagtataaattcaaccattgtgtgagacagtgtggtgattcttcaaagacctagaggcagaaacaccatttgacccagcaattgcattactggttatatacccaaaggaatataaatccttctgttataaagatacatgcacgtatatgttcattgcagcactattcacaatagcaaagacatggaatcaacctaaatgcccatcagtgatagactggataaagaaaatgtggtaagtatacaccatggaatagtgtgcagccataaaaaggaacaagatcgtgtactgtgcagggacatggatggagtttaaagccattatgctcagcaaactaatacaagaatagaaaaccaaacaccacatgttctcacttatcagtgggagctgaatgatgagaacacatggacacaggttggggaacaacacacactgaggtccatgggtggaggggtgagggaggggtggagagatggagaatatcaggaagaatagctaatggatgctgcacctaatacctaggtgatgggatgatctgtgcaggaaaccaccatggcacagatttacctatgtgacaaacctgcacatcctgcacatgtaccactgaacttaaacgttaaaggaaaaaaaaatgcttttcttttgcatcaggggagttaagagagaatggagagaattgttgcagataaggtctgtttgttgatttttctcaggatatgagtctcgggggacatgtaagaaagaaaacatagtggtcaagaacttgagctttgttgttggagtccggcaataaatcccatctcctgtgtttactttctgtgtggccttggacatgttactttaattcatgtgagcttcaatttaatcatctgcaaaattgagataataatagtcttccccaatggggttgttgtagagattaattgggaagctgtttcttaagcattttccatagtgattgttatataataagaactcaataaaagccatcaccatcattgtcatctcatctagagatcgttaattttcatctctttttctatctactacattatatcttgcccaagatccttctcctgtttgcttgattatagagcatatatgactattgcttaatgtttttgagcttgattggataaaagaatgatgtaatattatgctccaatgtcctatttatcatctggcaggctttgaaagggtgtctgttccatagacttctgtccagttgataacacagtttgctccagcagcttattcctcaggtaaatgagatcttgctgaaactacagttgatagtgagatgcttctgtaagcactggggtttttttcaggtggcagactaacagaaggatgtgtgtatcccactgctttgctctgctcaccttgctcttttcactcaggattcactgttgacttttctcagccataggaaaggtttacataaccaatcttcatgaaatcagttaggactgttattaatgggtcactgtcaaattaattattgctgaaattttagctctttgcaatagatgaagcaactgttaaagctgcattgaaagacacttgcattttctcctcaaagattcattattcccagtgtttctcttcataagctctgtatggttagtgacccatatatgaccctctaaaattgttaagagcttcaaaagtcaatcctatattgagtgccctatatttttttgaactatttgttgggggttacatatagatgaaaaatgttaaactttcattaatataaaaatgtatgacaaagcaacagcaatcaagacaatatgatactggcataaggatagacatatggatcaatgaaatagaattgagagttcaggtactaactctcctgtttatagtcaattgatttttgacaaggtagtctagatcattcagtggaggaaagaatagtattttcaaggaataatgctaggatgactggatattcccatgcaaaagaatgaaggaaaatgcctaaatcatatcatatgtaactcaaaatggatcaaagacctaaatataaagagctaaaactataaaaatccttgaagaaactataggtgaaaatgttcatgatgtttgattaagcagtgtttttttagatatgacaccaaatcacaaaaactaaaaagaaaaagaatagataaatggaactttaaaaaccctgaagcttttatgcttcaaaggacatcacccagaaagtgaaaagacaacccatagaatcagagaaaatatttgctaatcatatatttgcagaatgggagaaaatatttgctaatcatatatttgataagggacttctatctagactgtaaaaaggactcttataactcaggaataaaaatgcaaataacccaatttttaaatgggctcaaagaatcttaataaacatttccccaaagatgttgtagaaataaccaataagcacatgaaaagtttctcagtattatgaaccatctaggaaatgcaaatcaaagccacaagaaaacaccacactgactaggatggctacagtcaaaaaaagtcaaataataacaagtttcgacaagaatgtggaaaaattggaaccctcttacactggaccagaatgtttacctacataacctactgctccagtgacatttggggcacatttgcaaaattctgagagttgaatagatcagcatttgacaactactgcactaaagtatcttctctgaaaagaattttgctgtaagttcttttttttttaaacagaaactatcatgttttgggttacatagctccccaactggagcctagagtagctaagacgtggtacttctgattaaagacagatacatacgcttaggaaaccagatggaaatggacaagttagcagagaagtttattgtgaaaataagggttagaacatttcacttggagactgttttagctgcatgtcacagacactcaaaatagatatgagtttctttttctcaggtaacagtccttaggtcagtagtctaagactggtatagtggctctgctccctaaggtcaatcagagaccctgtctcctctcttgttgttaatttatcatctctgaggtatctcactggcttggtccaagatggcttaccatgtctgtgttataagcagcagattagagcataggggaaatgaaacagaaagtagggacccctccctacaaggacaaactctgacgttgcgtgtagcagttatgctcacattccattggtcagaatttagccatgtcgtcacacccagctccaagtgaggctgagaaatgtagtcttttttcttttattctgcctgtataattgcagaatagaaatatagtattttacatgtgccctgctaaaaattgtttttctgctgtgtgccctgctaaaaattattctactatgaaagtaggtgacaacagatattggagtacaaccagcatccgtagctagagagtcttcagggttacctggtaggcagtcatgatattcctcagaaagcagctttggttcttcctcaatacttcgaacatatcctcaaatagatcctaaagttctatatcatataatatgtcagaaatagtgttagcttgcaaattgttcagtacgtctatagtgacaaatattgtcttttcctattggttctacccctcttcatctgacgatgaactcccttttctttaggtaaacaatagtttcctattccattgtggttttgatggggcttcccattatagggtcgccctgtgacactggcctggccaattgttgtactccatcctcctgacatttactgggtgatctgatcacagggcccagacaaggatagtgtttcatatgaagacagtgagaaaggtaaactgtctttcctgtagttaaataagtttaggtataatactgaagctttcattgttcatgctccatccttctttaccactgtcgtatgaagaaaacctgtcagtgttagagagagaaaaagagagaaggagccaaatgaacagaaataagcaaacttgagagacaaagtcttgatgacatcatctgattcccttgacacagttctggtcaatgaggtgtaaagagaagtgttctacagatttctgggaaagtctttactttctttctcctcctcctccttggaataacagtgatggaagtgaccagccacttgtgaccatgtgatgacaaacaagaggagaaaacacagtaaggataacaaagtggacagagaaaatggtcctaagatatcagtgacatcatgcagctactgcaccagccctaactttaggttatgtgagcaaaataaacctaaacagttaagtcgttggtatttggctcactattacataaagccaagcacaatccttactgatcagatgttcttacagtattctaagtctgagatgataaaacccagggaaaatactgagcacacaatggacttcaatgctgaataaatacttgctgagtgaattaataaatggattcctgaattcatagtaattctcatttctgttcctagaagtagaaaaaataagatgtatacaacatatacttcaaaagaattggaagaaattgttggctaactccatgtttgagggagacagataggttaagtacataccatggagtgctttgaatatcagattgaaatgttttgcttaagtcagtgagcaatagagagaagttggtgtttgtgcagctagacaatgacttaaacaggtgtgcctgaaagttcagatccgttttagtctgaagctctcagttgtgctcccacatcgataatagtcatctgtaattatgtgatcttcaaacataaatattatagttacattttacctgttgtattataatgaggacctattatctcattatttagtaaggaaatatctgtactatgtagtatcacccattgttttcagaagctacaattgttattgattatatagaagggcgagagtgctgagattgccctgggttacgttcatttggctgcagtaattattcatttattcctgaatagcaagtaatcatcttattaagtctacttacagaggtagtgtatgtaaagactaacacatgctcattttcaaatcagtgattcagaataaataaaacttttgtaggaaaatataaaccatgtttttaggggcaaagaatagaaccacatcattggagatctgatgtgggagttctttgatctctgcactacatatcctggagaagaaaataaagacaacttataacactaattgagcattccttcctttgccttctccccttcctcctcctcctccacttaaccacttggttttaggcacttccttagccctcccttcccttcagtccccagtgtagatccacttggtaacctgtccatgaatgtttggtgcctgttcttatgctgtctttgatagttaaaaattatgattttttaaagtaaaatctcatttgcaaaaaaaaaattactttagccaacataaaatatacagtacttagttcaccatttctaaacatttctaaagtagtggttatttctatccaatgtaaagtttccctttccccagactttttgccattatttattgtatttgacttctctacaactatctaaagaataaagaactacataaaacactatattcaactctctatgaagcatgataaatttacattttttaaaatattgtactcaagctggtaagaacaggtaaaactccctttgctccagctacatctccatctcagtcagcccctgtcctctcaaggttactattaatatctgccttcctgtctccccgggcctctcccatctactcctctgtaatttccatttcttcccattcatgctaaattatgtcatctctctgaccctgaattttctcttgaataattgttttttcctcacctactgttctctgatttctaatgcttttaataccatgtacttgtgacacacaaaaatatttgtgcagaaggaggaaagtcctaggaaaatcggttctaactaatttatgatcttttccaagtaaaaatgtgacaaatgagcaggctgttcaaaataattaagggtccgtggtttgcttggtttcctatctgagtttgtacttttctaacaagcaacttctgggcttttggttactattacataaaggaatagacttttaagaaaaattaacattagagccatggaagtgtatataattctcatctaagatttcagacatttttagattgcttatttctagaactttggctcttcctcaaaggttttccacagcaaatgacttaaaatcctctcagataatagaggaataaaaaataaacaccatggcttaaaccccgtaatcttccttctacattttttaagattctcggactttagcaaatgccacaggtggcccctcaccattctttctgaagactggcccatttagtagtgtacctttgagagacaaaaaatacactggggagatggaaggctttgatgatgctggtggttacccaaatgtatacatttgtccatgcccattcaactgtacatttttaaagggtgaattttattgtttacaaattatacttcagtaaacctagctttaaaaattgttgggctactcagtgcagcttttgtcagaatgtgtattacttaggcaactacccaggatccataacaccataacaccagctaacatattgggaactcaccctgtgtgagacagtagtctaagtgttttatataggttaactcctttaatcttcataatcactctctgaatttggggttacttttcagattggatagatatggaaacaaagtctcaaggaagtcctgtaacttgtacctagctaataattatcaaagccaggtgggcaggcacactctctcacatacacaccccacttgagaatatattggttagaagcactacagtttagtgacctaaccggtatggatgtgggtgttcttagggtcagttaagcaaaaatgaggctttacaaggccttaattgtccttgtatataatttgcattttattgaattgcaatggtaagccattgaagagtcaaaaacaagagaatgacatgatcagattcacatttggaatagtggcaggtggactaggcagggagacccagcatggtaatctcctgtagtaattcagataacgaaagcataaattgaagcactcatttggggaagagaggagaaaaaccagtaatgggctaactttgcatttgcctgagaggcagtgtctcagcacatgtattgaagcagagcgagtgctggagagctttctttctccagctgttccaaattggataacaaaaggcaatgactcttctgtttacatgtttgcttgtaggcatcagctattcctaaactggaaggcccctgattggcatctccctgcactttgcaactttattgaactcttaaccagctcactgtttcctttataccctaaataaaaatgttagactggactattgtctttttaaagtttcaaggagaagctttttatttgttttactggtttcctttttttaattttttttattatactttaagttctgggatacatgtgcagaacgtacaggtttgtaacataggtatacacgtaccatggtggtttgctgcacccatcaacccatcatctacattatgtatttctcctaatgctatacctcccctagcccctgaccccccaacaggctccagtgtgtgatgttcccttccccgtgtccatgtgttctccttgttcaactcctacctatgagtgagaacatgtggtgtttggttttctgttcttgtgttagtttgctgagaatgatagtttccaccttcgttcatgtccctgcaaagggcatgaactcatcattttttatgactgcatagtattccatggtgtatatgtgccacattttctttatccagtctgtcattgatgggcattcaggttggttccaagtctttgctattgtgaatagtgctgcaataaacatacgtgtgcatgtgtctttatagtagaatgatttataatcctttgggtatatccccagtaatgggattgctgggtcaaatggtatttctggttctagatccttgaaaaattgccacactgtcttccacaatggttgaactaatttacactcccaccaacagtgtaaaattgtttctatttctccacatcctccacaccgtctgttgtttcttgactttttaatgatcaccattctaactggcctgagatgatatctcattgtggttttgatttgcatttctttaatcaccagtgatgatgagcttttcttcatatgtttgttggctgcataaacgtcttcttttgaaaagtgtctgttcatatccttcgcccactttttgatggggttgtttctttcttgtaaatttgtttaagttctttgtagattctagatattagcactttgtcagatgggtagattgcaagaaatttcttctattctgtaggttgcctgttcactctgatgatagtttcttttgctgtgcagaagctctttagtttatttagatcccacatttgtcaattttggcttttgttgccattgcttttggtgttttagtcatgaagtctttgcccatgcctatgtcctgaatggtattgcctaggttttcttgtagggtttttatagttttagttctaaaatttaagtctttaatccaccttgagttaatttttgtatgaggtgtaaggaaggggtccagttcagttttctgcatgtggctagccagttttcccaacaccatttattaaatagggaatcctttctccattgcttgtttttgtcaggtttgtcaaagatcagatggttgtagatgggtggtgttatttctgagacctcttttctgttccattggtctatatatcaattttggtaccagtaccatgctgtttaggttactgtagccttgtagtacagtttgaagtcaggtaacgtgatgcctccagctttcttttgcttaggattgtcttggctatgcaggctcttttttggctctcaccactcctattcaacatagtattggaagttctggccagggcaatcaggcaagagaaagaaataaagggtgttcaaagaggaagagaggaagtcaaattgtctctgtttgcagatgacatgattgtatatttagaaaaccccattgtctcagcccaaaatctccttaagctgataagcaacttcagcaaagtctcaggatacaaaatcaatgtgcaaaaatcacaagcattcctatacaccaataatagacaaacagccaaatcatgagtgaactcccattcacagttgctacaaagagaataaaatacctaggaatccaacttataagggatgtgaaggacctcttcaaggagaactacaaaccactgctcaaggaaataagagaggacacaaacaaatggaaaaacattccatgttcatggataggaagcatcaatatcgtgaaaatggccatactgcccaaagtaatttatagattcaatgctatccccatcaagctaccattgactttcttcacagaattactggttttatttccaaatatgaaaaaagacaagcatgttgaaatgtcagtgggaagaatccaattgaaagagagattggaatttattggaatgagaaggaaaaaatgatacaacgacattcctaaattagtggagaattgtatgtccctaaaaaaggcagagaggttaacattaggatgcaggatatttcttctaacataaccgaaagtaagagggaagatcaccacagatgcaagtgcagcacttccctcttatctgtgggtgatacattccaagacccccagtggatgcctgaaactatacatagtaccaaaccctgtttatcctatgtttttcctgcacatacatatctatgataaagtttaacttataaattagtcacagtgagagattaacagtaactaataataactaataagatagaacaattataacaatgagccagcatcatcataatgcttgtcctttagggccattattaaaataagggttacttgaacacagcactgtagtacaggaacagttgatctgatcatcaagatggctactcagtgaataatgggcgggtcatatataccacatagatacactggacaaagggatgattcacgacccaggctggatggagctggaaggtgtgggagacttcatcacactactaagaatggcatacaatttaaaacttacggactctttatttctggaattttccatttaatattttcaaaaccatagaaagtaaaaccatggatgagagaggacaatggtagattcacaggttttgttaataggtatttgaaacatgcccatttgatgattttttcctctgtgaactaagatgtaaggccatctattaaggaataagtagggcttacaggtttgagatgggtggcaggaacctgcttattctatttaaattttaacttttagcctagtaaatataaatcaaaatctagaaaaatacttacaaataatggtgaaatataaagatttctaaaatttaagactggaggcataaaaacacaatgtaaattcaggccacaaggactgaacctcaaatttggctctaaacttcttggcagcccaaaaaagaggtagattcagttactaataaatcgcttaagagtttactaatttttggaatgtagctcttttaaaatttttaatattagaatggtcttagatttacagaaaagttatggaaatggtatagaaagttgccttatatactgtacccagtttcccttcttgtcaacattctacaataatatggtacattttcacaactaatgaaccaacagtgatacattattattaattgcagttcatattttatttgcatgttctcaatttttgctaaagacactttactaacatcctttttctgttccaggatcatcctggataccacattacgtttggttatgtctccataggttcctctagaatacgacagtttctcatagtttccttggtgttttttttttttttttttttttgagacagagtcttgctctgtcgcccaggctggagtgcagtggcatgatcccagctcactgcaagctccgcctcccgggttcacgccattctcctgcctcagcctcctgagtagctgggactacaggcgcctgccactgcgcccggctaatttttttttgtatttttagtagagatggggtttcacagtggtctcgatctcctgacctagtgatccacccgcctcggccccccaaagtgctgggattacaggttccttggttttgatgagcttgacggtttttagcagtactgctcagatattttgtagaatgtcttttaatttggatttgtctgatgttaagggaggagtatctacataaatcacatggaattcttctgttcaagggatttgtctattctccttcatataggatacgtgttataaataaaacattttattgaaagatgtgtctttaactctcaaaaacatttaaaaatcggttaatagtacagattgcaactgtaattaattccttctatgccaggcatttctaagtctttcagagctttagtcttttcatttgcaatatgtgagatttgcactatgttatttggccttcacctcccttactagtctttcattagtgatgttgatgacctgagggaaaacccatgactgacctccagtggtaatatgtgctgtggtccaagaaataaatgcctatttgttgacttgagatgagttggagcaactaggtagttaagaaaaagtagcacagatagactgcttctaattgttgatagttcatgaaaagtttcaattgtctatgaaacgactagagaagtttctttctagaagtaacccataaatgtctctttcttctaattttgtgaaatttgagccatttggtaaaaaaaaatgagtctaaacactctattcttcaatctatagataactctaatcctagatataatcatttcataaatgtttctcctgcttaatttatctcctcaacattttagaagagttttggcagtcattaattttagttctaaaatattttctgaaattaacttcccatcattctagttttttcctcaggcatctctcttttcatggagccatattcacataaattctaagatctttccctttcaatagccttggaagatatttgtgaatctttggaatgtgggtgtctctctatctgtgataattcctctaatattgcttttagcattctccagggcaggtgggtggatctaggttctctggggcctgaagttggtcctttttaaaaagaatacaaattataattacaaaattaggttcagggtcataaaatggcctgtgcaagtaagaggccttggagctgaaactttttttgtttgtttgcttgtttgtttgcttgttttgagacaaggtcccactgtatcacccaggctagagtgcagtggtgcaatcttggctcactacaacctctgcctcccagattcaagggatcctcccacctcagcctcctgagcagctgggactacaggcgcatgccaccaaacctggctaatttttgtattattttttttttcggtagatacggggttttgccatgttgcccaggctggtctcaaaactcctgggctcgagtgatccacctgccttggcttcccaaaatgctgggattataggcatgtccagcagcccgggctgaaacttttttaatattttggtaaatcttcctcaaacagcctcaggtgaaaactgacattactattatattcgtgttctcttgctgctatagaaattatcacaaacttagtggtttggaacagcacaaatttatctttcagttctttcagcagtctgacacagatgtctcactggactggaatctggatatcaagccagatgtcagtcccatgtgctctggaggctaaggctgaaggatcacttaagctcaggaattcaagagcagcccagacaacatagcaagactcagtttcaaaaaaaaaaaaaaaagaaaaaagaaaaagaaaaagaaaaaaaagatgtcagcatggctttgtttgcttcaggagggccataggggagaatccatttccttgccttttgttttctttttctttttcttttctttttttttttttttttgagacggagtttcactcttgtttcccaggctggagtgcagtgacgtgatctcagccactgcaacctccgcctcccagattcaagcgattctcctgcctcatcctccgaagtagtgggattacaggcatgcgcaatcacgcccagctaattttgtattttctagaggcttcctgcattatatggcttatggtattcttccttcatcttcgatgccaacagtggcaggtcaggttcctatattgtattaaatatgtctctgactgctcttccatcattacatgtctctttaagcacaggaaggaacagttctcagcttttaaagacttgtggttagattggacctacttggataattaaggataatctccccatttcaagatctataaccttaatcactctgcagagttcctgctgccatgtaaccaacaaaccttcaatttgtaaaaaacacagtatctgtgaagcacaataaagccaaatgcaataaaaagaggcctgtttatgttagtaaaaatgaaagagaaagtatataaccttccctcttttccaagagaacattaaacaaaattataaaatctttgtgaatacccaacattgtaactatttccggagctccttgatgaaaattgtttcatttcattggtctagagagataatctggatagatggagcccaagattaatgaccaatggtagtttatcttatgcatctaagataccatgtgtattttaaaagaaaactttagtctcttaactcctctcccacacgtaagaaatgtggtagtttcatacactgttgggcctagacctgtttcagattgtcccaggtatttccctcactcccattaccctatgattcttttcagttaagtgtctttaagagatggaagctcaaaagttaataagagaaagtctattgaattatatataggtctagtagcaggtcatatacaatttgtattatcgattttctcacataaaagaactctagaacaatggttctcaaattgtttagtttcagaattcctttacagtctaaaaacttgaggaccacagggaacttttatttatgtgggttggctataactcattactgtttattagctataacctaatatttaccatataaaaattaaaatgggacatttaaaaatattaattcatttaataaatattaataaaaatgccttagatgtaaacataaataacagtcatatttccaaattataacaattatatttttcaaaacaaaaacaatcactggcattttctcaaatttgtgtgaatttctttaatgtatgccttaatgaaagacagctagattcctttatttgcttcagtctgttgtaatatttgttttggttgaagcatatggagaaaatacaaccttacatagatatgtagttagaagagagagtattttaataaccttaaagataattgtggatattcttccttgataatgcattaaaactcaaccagtggtagtatattttttaatctacttttttttttttttttgagacagggtttcactttgttgcccaggctggagtgcagtggtatgatcgtggctcactgtaacttcgatcacccatgctcaagccatcctcctacctcagcatccctagtaactgggaccacagagacatgccaccatgcccagctaattttttttttttgtagtgacagagtcttactctcttgctcagtctagtcttgaactcctgggctcaagtgattctcctgcctcctcccaaagtgctagaattatgggggtaagccactgcatctggcctatccacattattgactgaatttgttaaacagctttgttgaaatacaattcacacatcatacaatgtgcacatttaaaatgtacagctgtatgacctttattatattcaaagttatttagtcatcaccacaattttggaataattttaacaacacattcaattttataatttttttcacaccaaaaagaaacctcataactacccccaatttccccatctcctccactgctaggcaaccactaacataccttgtttctctatctatttgcctattctgggcatttgatgtaaatggggtcatataatatgtggtcctttgtggctggcttcattcacctagtgtaatgtctatattattcctctacgttttagcctgtatcagtatttacttttattgttgagtaatattttattgtatagatatataccataggtgttttttaaaaatatatatatatttattaggtgatggacttttgggttgtttccaccttttggctattatgaatagagttgctatgaacattcatgtgcatgtttttgtgtagacatgtgatttcatttgccgtaggaatatacttagaaataaaattgctagatcacatgggaagtccttgtttaaccatggtagtttcttaaaggttagttgcaaagtgaaatcggaaaccatgacaacagacttttcttattctgttatgttatagttcattggtttctcttgacttagaatgaatctttcacccatgcacgattttgtaacattatatattagtcataatagtcatttggaaaatatttgtttagttagttatgcagatcttccaaaagtttatacattttattacacaatatcaaaattcacattggttaatattaccactgatttcatcagaaaaacctaaatattgggaattttatcaggttcataatgactcattttagttttcaaaaatgctaatttttgcttaaaagcttaaattttatcattggcaacaaacgctatctatagttttccttgaagtaacaggcccgctttgttcattgtagagaaaatgtttgtgaagtacccaatttggaggaactgtagttttgtcagttcctcaaacaaaaatgcttttccataaagaaatcagttagtacagcttgcagtttagttgcacatctgcttttccttgaggctatcattttgtggtatgcagcaaaaatgtcttatgtgtacttcctatttcattgaactgaatattaaaaagatgtttattaatgggtcaggatttaataagatgaataatttttgctgtttcattaagaacatccttaaatgaaacttacttagtttgcttcttaccgcaagtgtatggtcagaaggattcagcaagaaatagctgttttcatgctactgcctggattcatgctaaggcactcagtattgctcttgcaccatcagtgcacatgtcaacagggtgaaaaacacaagcagtgccttagaattattatgaaattagttttgatgttaaacggtccttaatagggtctctgggacctcgggggatctgtggaccatgctttcacaaatgctcctctcacacacccaactttctgtccctgtttctttttttctaaaactaatatttccagaaatgttaagattaatggaaagtcatttgtcattttgagtagaaacaaatatatttttgttatcttggaatatgctgttgttttgatcatatttctcctgtttaattcctcaaggatctagaaccagaaataccatttgacccaccaatcccattactgggcaaatacccaaaggattataaatcatcctactataaagacacatgcacacatatgttcattgcagcactattcacaatagcaaagacttggaaccaacccaaatgcccatcaatgatagacctgataaagaaaacgtggcacatgtacaccatggaatactacgcagtcataaaaaatgagttcatgtcctttgcggggacatggatgaagctggaaaccatcattctcagcaaactaacacaggaacagaaaaccagacactgcatgttctcagtcataagtgggagttgaacaatgagaacacatggactcggggaggggaacatcacacaccagggcctgtcagggggtggggggctaggggagggatagcattaggagaaatacctaatgtagatgatgggttgatgggtgcagcaaaccaccatgtcacatgtatacctatataacaaacctgcacgttctgcacatgtatcccagaacttaaagtataataaaaaaaagtttcatgatctaaagaaattcagaaaataaacaatattaaaatgaggaaacattggaaattagttttttacttatttgcctaatattgagtagtgaattttcttattctaatctggaaaccaagacttttatcagctattttactagaaaatctatgtgagatattgtaacttagaaaaagtccaaagcaaggcttaatttgtctgtcatattgaataatcttcaaataatcttttagtcttcaaaaatggttatagaaaaactgttagatttgagaaattggatatgaattatgctgacattctaacattctcaagttaaattcccctaagcagtgttttatgggaaatgaattcatttgaacaacttaaagaaatattttaagaatgagatgtgcctttagttataaaacctcttactgctgcaaacatatgtaagaattttgcagtaggttgaatgaattagctatataaaagtctgcaagtaaacttccttcctatagaaaatataatagacaggaaataaattaagtagagatatttagctggttgaaatcagattcatttttgtcagtgctttatttgtgatatatttttgataggaattttcagaagacttaaagtacatatttatacttttgtactttaaaataatcacattattaatagtgatgaaaatagcaatagataatacttattgactgcttgccaagtactacctgttttttttatatgcattatctcattatctcatttaattctcaaatagctaaatgaggactgttcttaccgggaacaaataaaccaaaaaacatacaaacaaaaaaaaactcaaagctttggatgtggcaatcattgacatacttatttgttatgggagtaatttcactaccctaaaacagcatttttacactctaagcagtcttctgtttgataacaaggattgttttgtggtagatgttttgctttttgctctcttttaacactagtaaaatagactggaaagtcttttagcctttctataaactttaaaacattgttttctttccagaaatactgttctgatagactgggtttgattgaatttttctgtaaagaaatacagataaaggataagatgtgatatctaaaaattttaggactctgaggactaaaaatgataaagatgaaaatgatgacatttattgtatacttattattagctaagtatggtaaatactgagtattagccctctctataactccatgaaatataggtactattcttattcccacttttcaaaagggggaactgagacacagaaaattttaagttattttccaaaggtcctgttattggtaagtgatacagccatgatttcaacccagattttatgtctaaagtacggctgtgtttctgccattagactagcaatctggattcctaatcctggctttagagactgtgttcttgtgcaactttcctaaactctttaaacttcactctcctcatctatcaaatgagaataagagtagcagtgcttaacgttatgagcatcacagatccctgtggggtgtgttgtgagaataaaaaagaaagtaaaagtattcagcacaattcttggtacacaaaagtactcagtaaatggaaatatctatggtggtgaaataaagtctctcttattgagtgtatttccagccatgtggtccttactactatgccacaatactaaatattctgctgacttcctgccttctattttaagccagtctaatatacacagcagccagagtaattatcctaaggtttatttagggtcatttcagtcctttcttcaaaaaccttcattgcttccctttgcctgctgaactaaataagaactcagcctgctactgaagcctccaatttatctttcttgctttattctttctcacagaaacctgtgtagttctcatttggagtgggaatacagttgtttggaaatgttttagaacgtcagcattactaaaggtctacactcagcatttagaggattaggaccagggacactccatattattctgtgagtgtgacaatctcagacatgaatagtctcagacaaatgtggatagtcaactttttccacttcctactctgacccccctccctattttcctactatcattcctttactcctgctatctatttgactatttctatctctctttctaattctgtggcagctgtcatcttatctagccttcaaggccaagcttaaatgatcatttgtatttctggattcctccagtttctatgtgaaaccacccttgtatcttttttaaaaaaatcttagatagctttaccctttatacttgtttataattataattatttttcatgaagaagacaattgactaccatgaaatcttttttaaagacaagttcaaagtctgattcatctttagtgtctcaaaatgtgactatgttgttataccttttaggtctttctggagggtagacagcctgttttacattctttgggcataaatactctgccttatgtatctcagcattgctgatgcctcacatagtaccaggccagtgaccaatgataaattcttgttttctaaatcaattcctgtaagtagactgaaagtttcttgaaggcagttaaaacaatatttattatttggtggttcacctatcaacattcttatttgcccatctatccattcacctgtcccttacttcattcagaaagactatgaaagagctggcaagagcagcgactatacttccctgtgtatatgaaacaatagatagcacgatttcttttatttactaggtgcttaatatgttttgttgtgtggacttgttagtagcctggagcataaaggaaaggtgaaaatgttttcatttcttctgttgttcagtggtaaattaccataaatgtcaaagcacccgggacctgaatgacaggttatagaaatgtaaaattggataaatatggtttcttttaacgtggtgacatgctatcaacaatatatatactctgaacagaccatttaaaaatagaagaagaagaagaagtcttgctatgttacccaggctgcagtacagtgactattcataggcgcagtcccattactgctcagcacaggagttttgacctgctccatttccaacctgggctggtcactccctccttaggcaacctgttggtctcctgattccaggaggtcaccatattgatgctgaacttagtgtagacacccaactggcatagtgcactacagcccagaactcctgggctcaagccatcctcctgccttagcttcccaagtacctagactacagacgcacaccataggaacctcttagtacttgtctagtttatacccctcagttaaataaacaataagaaattaaatgacaaattcaagggcaaacacagatttacattcagagattactggcagattatgtaggctactgtgatttcactagagaaaaataactccctaaaatagtttttattttaaattttatacacacacacacacacacacatatatatatatatgtatttttgagatggagtttcgctcttgttgcacaggctggagtgcaatggcgcagtctcagctcaccacaacctccgcctcccgggttcaagcgattctcctgcctcagactcccaagtagctgggattacaggcatatgccaccacacccggctaattttgtatttttaagagagatggggtttctgcatgtttggtcaggctggtctcgaatgcccaacctcaagtgatccgcccacctcggcctcccaaagtgctgggattacaggcctgagccactgcgcctggcctaaattacaattattttaaaagtgtttcagtataagaaggaagtctaggattattttaacctgagtatttcatgggatttaggcttaatccgggtcatttagaaatagtcctacgttatttaatgatttaaaacagaactttatgctttcattatttggattaaataaacttctattattttttcttatcctgaagcaataatctagagaaaaaagcagatgcctttaccaagtttcatgttaaaaaatttacttgccagccagatgcggtggctcacgcctgtaatcccagcactttgggagcctaaggcaggtgggtcacctgaggttgggagttcgagaccagcctgaccaacatggagaaaccccgtctctactaaaaatacacaattagccaggcgtggcggcacatgcctgtaatcccagctacttgggaggctgaggctggagaatcacttgaacccaggaggcggaggctgcggtgagccgagattgcgccattgcactccagcctggggaacaacagtgaaactccgtctcaaaaaaaaaaaaaaaaaaaaaaaatttacttgccaaaataagtaccaggaagttttcatgtcttctaaaatttgcctttgtttcaatgtaataattactcatgtgttattattataagtaatattattagccgtcttctaaatgaggtagtacagtatagtgcaaaaaccatagaatggtcagaaaagctgttttctaatcctggcgctaccacttactggctttgaaagacagcaaattctgtgattcctctgagcctgtttcccagtctataaatttgggatagtactccttaatccttaatcttattgtgaggccttgctgaaattatgctcattgaaaacaaacacttaagcttggcatttagtagacactcctcaaaagttgtagtagttatcactgctagaatctgctaccatagattaatttgtaagtttttaaaaactctttattcccttgataaggaaaagtgtatgcttaaatatgttttggcagtttataatggatcactgtctagatttcttttggattctccattaatctgaactaaaaatcagataaatttctgtaaaatttgttttgccacacctgatggaatcatggtcaagtcactttacctctctgggcctgtttcctgctggcaaggggagttgtgacgtgtgaatgttaaagcccctttcagttcgagaattcagtgattatttttggaatattattattataatgattcattctaaaagtccaactttctttcaaacgtttattgtctttttttatgcgatgctagtatatatgtatattataggcaatatatacatagacataaatatatatatgtaggtaggtgttttctaaacctagtctatgatgataatcatcaggagtgctcattaaaatgagttaaaaatctcctctacagattcagtaggtctggagaaggccccaggaatttgtagtttgatgagcataccacatgattattattatcaccaagtttaaaactgctgtattcttttactctgttttagctaaaaattaatttggactttaccattttggcagggagagggagaagaagagcctatatcttgagatgctgaggtccagtctctggacatttatttcatgcaacaaatatttattgtatgtttactatgccagataataaaggaatttactacctagatggataattttttaaaaaaaatctcacgagataatgagtaatagatgtataaagaaaggactgaagagcagagagaaggaaatgatcagttctgcctataggggtgaaggagaggtatctcaagacgtttaagaggaagtaacacttagggtgaactttgaaagataaataggcatttcaccagcagaaaatatggagaaagggaaatgatgttaacaagaaagtataagaatgccagatatggccgggcgcagtggctcatgcctgtaatcccagcactttgggaggcagaggtgggcagatcacgaggtcaggagattgagaccatcctggccaacatggtgaaaccccgtctctactaaaaatacaaaattagctggacgtggtggcgggtgcctgtaatcccagctactcaggagtctgaggcaggggaatcacttgaacccgggaggccgaagttgcggtgagccgagattgcaccagaaatcctgtctgtaaataaatacaccagatataaatctgtctctagacaaaagaatgaagaaaactgggaataataactataaaggactttttcccccacattacaaaaatgtatttgaaataattgactgaagtgacaataatatattgggggttaataacatatatgaaagcaaaatgtctgacaatagtacaaaagctgagtgaggagaaacggagatgtatagttgtaaggttcttagactatatgtaaagtggtagcatattacatgaaggcagattataagttaaattttaaaaatatcagcacagatacacatatacacaaaaattgaaaagtcataagatttgacaattcagatgagtaaatttgggagctaagaattgcatctctcctgtacctcaaaaataatttctcacatagatgatctattttaagcctaaaaatgaaggttgattgtgtgaaacatatgcaaataatattactttgaaatagtaaaacctaggttttgggttatttgtttggggtttttttgtttgtttgtattttgtttgtttttgagacggagacaggctctgtcgcccaggctacagtgcagtggttccatcttggctcactgcaacctctgtctcccgggttcaagcaattctcctgcctcaggttcctagtagctgggatatgggcacgcatcaccacgcccagcaaatttctgtatttttagtagagatggggtttcaccaggttggccaggctggtctcgaactcctgacctcgggtgatccactctcctctgcctcccaaattgctgagactacaggcgtgagccaccacacctagctgtttttgtttttctgttgtttgtttgttttttgttttaacacataacttgctttggacagaattaagtgtaactcctgtaaggaacaagaaaacaatataagcctatacttacacatccattacactgaaagatttctaaacaatttttccaccctaatttatgctaggctttgttgttttaagatggcaaagtgtataaatggtgccagtccctgctcaggcaaaattttgaagtagaagaaatgtgttgtccattccctgtccactcctctttgtattggttatcaacctcatacccagcccttgcagctcactcatgatctctcagctgttaatttttttttctgatactctgttcccagaaaaatgtacccatcttggtaagcagtactttcctttctattgtgataaatattaacaatgacataacctcatggagaactgcagtttgctccgtcagtaccatgctccaaacaactgggaagggtgagagaaaaagggcaaatgatgtacttttcctctgtgtgatattgtgacaattttctagcatgtttcttatataatagtgactgataaaaagccttgataccagtaagcagtagcaaatgtactattaatgtatttcctttataataattcttcatgtgtatatttcaaaaaaaaaaaaaaaaaaattctgtcaattgtttctcagagcaatcccaggagttttcaggtttagaaaccgaatcacagaaagttgaaatgacaaaggtaatcaagtaaagcctgaactagaacctaggtctgctgaatcctagttaattgcattctcaaaagcacaaggaaaaatactggaattgagtgacaaagtggttgtctgcatgtttgggactgctggcaagaactcatctagactttttacagcttgaatagaattcattactatatgatctttgatggaaatgttagaattgttcacaagggaaagtctaaaaattctgtccgtgagcaacctcagaaaactgccgatgctgctaaacttaactctgagaatggaattccacagattatctggtattttctgcagcctgcccaactcaataaacccttcattcgcctctgaatataatcctttgacctcgttctcttttagttatttgttttttcattaaagtgttattcttttagtggcttttttaatcagctttgatgcctatggctacaaataacagaaaacctagagtattgtacaggaaggaaatgtctcagctctcttagctcttgtaaaacccagaggtgactccagaatgatctcagtcgaatacagcttcttttctcctaactctctctgctctgctgtccttgatatgttggtttcatcctaggctgctttcctcatggtggtgttatggctataatagttcctatgtacatgtctgcacttcacggtggccaagttgtttcccaaagctaccttataagcatgaggaagcttccttcccagaagccttgagaaaacctcttcccatgttttattagaccaaattatatctcatgccattcctgaaccaagccctgtgatttaagcagtgccatatctgaatggcttaggcttgagtttctgaaccaaaggaaaggaagatcacccttagacccattccacccctggatcctggaggttgctgtgtatttccctgagacacatgggctgggagaagggggtgctgtgaaaaattagatttctcttaggataggggaaagtggaatgtatggtgagtaggtaatgattaatgtctgcatcaattgtcttgttttttcctcatctggcttttagaatcatgtagaatagttaaaatagtgtaaattttgatgtaagactagcttttagagacctcttctggcacttggccaggttccttaactgctcttctatgcctcagtttccccacaattttataatgattaaaaataatgtagtctggccaggtatgggagtttgcatctgcaatcccagtactttggtaggccaagacaggaggattgcttaagttccggagtttgagaccagcctgggcaatatagtgaaaccttgtctctacaaaaaatttaaaaattaccgggtgtggtggtggatgcctatagtcttagctactttggaggctgaggtggaagaatcacttgagcttgggaagtggaggttgtatgcagtgtgctgagattgtgccactaaactccagcctgggtgacagagcaagaccctgtctcaaaatgatgatgataataataataataataataataataataatgtaggcaaggaacttagcacatagtatatatttcaataagtaaatatagctgttattaatggtttttttttacttttgaaattataaacaataagtgaaagttcctttttctcctgctgaggcctgtgctatccccaaatagttattattaaaattagtagacaagaaactgttcattagagaatgtaggtaggatgcttaccataaaattctttcaagtttttctgtgtttgaaaattttcgtgatgacattgaaaaaaataagtttacaagaatgatagtgttgcaataaaaaccactgagggtgactcaagagaactagaaaccaaaattcttcttaagacagcagtaagtttaacccagttcaggtgaattgctggaatgatgttttcctcttatgtcccaagcattccatttctttatgaggaaatacgcagtctaaaatactgggtttcctgcattgaaactccttggccttaacttttgtgtgggcagcctacagcaccaaagtataatgaaatatgtatgagatctcactaaaagagctctggagttagccactgagaaataaagggtgggagggaaagctgtgcatagaaggagaaccaggaaaatgacctttattgagttcccattatgtatgtgccaaaggctctgtggttataaggataaataaaatactttcccaacctcaagagagctcacaccttagatcagaagacacccctctcagtaaataattatggcatatgataagaagtgccatgtgtcagctgggtacagtggcttacacctgtaatcccagcactttgggaggctgaggcaggtggatcacctgaggtcaggagtttgagaccagcctggctaacctagtgaaaccctgtctctactaaaaaaaaaaaatatacaaaatacaaaattagccatgtgtggtggtatgcacctgtaatcccactacttaggaggctcaggcaggagattcgcttgaacctgggaggcggagtttgcagtgaactgagactgtgctgctgcactccagcctgggcatcaaaagcaaaactccatctcaaaaaaaaaaaaaaaaaaaaaaaagtgccatgtgtctgagagcatactggagaaagaaaaactagaggatcttcataaatcttgcagactcctttagttagggttaggaagaagttgttaaagattgagattatttcccacagaattttgttgttggtttaagagcacaagtcactgttctgctgctgacttactaagatttaacaggaaacttagactccaccttttgcctttgtcagcaaaatcccccagtctctctgtatatggagatataattgagaaagattacttgcattcccttctcttctccataaataaggatgaagggctatcaaggtcagaccaaaatttttacaaagtaaattgacaatagttaggacaagatcttgatattaatccccattgccgtctcttttccctcccctgctatatataatcttcttgtccccagcaggttatctgttaagagtctgctctgttttgaccctagcactttggaatcagcccagttgacttttttataacatgtaatatagcccactcttcactgcttaattgctttatcatgctaactcctattactttaccagggcctttttcccctttcattttagtgattgtcttgttgcagaattcgctataacagaatctgacttatgtaagataagttatttttgtaacccttgtctagaaagctcttagaaaggcatgggcagaaagactgaagaaaccccaagaaaacttatcaggagttttttgctagtttgagattcctcaaaagactcttatctacattcattcctttttttgtttgtttgttttttgttttgtttcttttttttttttttttttttttttgagacagagtctcgctctgtcacccagcacccaggctgcagtgcagtagcacaatctcgactcactgcaacctccgcctcccaggttcaagcgattctcctgtctcacgctcccgagtagctgggactacaggcactcaccaccacgccgggcttttttgtatttttagtagagacggggtttcaccatgttggtcaggctggtctcaaacattcattccattttgtaagatggtaggatatatcaatgaatgaatgagcaaaacaattaaaaagtcttgtgcaaattttttgcaaggctagagacaagattagtagctgctaacattggtatagctctttacaatccatgaaattttttcacttacatcatttaatgtaatctcacaccatccctgtaaagtaggtattttctccagtttatgttgtcagtgagatctgcagagattacggtcccataacagggaagtggaagagccaaggtttcgcctccaggtcttctgacactgattacagagatattttattcttgaatctaggggacaagaagttatgagcatatttctttttggtaagtggaaagcaagcaggaattttccttaatgcttaattagtagactagaatttccaactaccccagtgagagaagtagtatcctgtaatggatacaaggtattttatatgagatatgcaacacaattttagattgcctaaaaaacaaaagggcacagattgatttttaatctacagataattttataatgaggagaattaactgaaattttattgcaaagattatggcagttcactgtatgcagttagcatgttcagaatggaactcctgatttttccctttctccaatcctaccgcatccatagtctttctcatattagtcatatacaacacccttttccagttgctaaggccaaatatgagtttatactcacctcctgtttctttcttagacgttgtatctaatctgtcaggagatcttcttggctctaacttcaaaatatatccagaatttgacttcttatcactaccttcactgtttgtctctcttccaagttaccatcatctctcacctagattactaaggtagcctcataattcatctcctttttgtaccctattctcaacacagcagccagagtgatccttttaaaacctaagtcaagtgagtctcttgtcccctcaaaagctttcttcaaggagtcctgcttcttttagagaaaagccagtgttgacaatgatggctttcaaggccctatgagatctaacccctccatcagtctctgacctcctcttctactatgctgtccatcacactgacctccttgctgttccttgagcatgtcttttgtgattcctgccaccagacctttgcaaaggtgctttcccagcagcttgagtctttactcaatgtctcctccttgatgaggcctaccatgacttccctatttaaaactacagtcttcctgtagaacccttcctgatctcctttactctgctcttgtctttctcataccatgtataatctactaacatactgcatattatttacttatttgtgacatttccctacctcctcgtaatataggctccacaaggagagtttttttgttgttgttgttgttttttgtttttactggtatctacccagtgccttaaattactgggcacatagtaggggctcactactaatttgttgaataagtaaatgatggatataattaatgaatcaccgcaaagaagttacagttttattgaggaggtaatattatgctgcttctggtagcagttgaccaatacagagccttatgtggtaaaactacagatagaagtggtagaagtgggagataattgaagccactggaaagggtatattcaatcacttcttggccttttggctgagatcaagtgtagggaaaatgaaagtttcactggctttggtaggttagtttgccagcattgcttatatactttccctcagctttttgaaaatcagatactctccacatgcagagataatggtactcatttatcatcataagaacatgcacttgttcttttgcaatagtaatgtgaaaggggctcacatttgcaaggttgttagagttaaaggtaaaggctatgtctatgaaacatacatatatatatatatttttttttttttttttttttttttctgtgtgaacccaatttaactgacccaatagcaaatgaactaacttgcctagataattcattatgtgggtagatgggatacagagattggaaaatgtcattggtgggttatgtatgtcagttggtagccagtataggtttgattttttctgatgctctggccagcccagttcttttggtttaaagtaccattttttcttttgatgtagtaagaacatttttctgtataaaatagtccattccttggaatggaaatggcattagatctttgtaacttaggtagtttttagcactggattgtttagtttgtaaaaatatttgatttagactgagcttgtggcctgatgatgtttagaagagcgccaaagtgtaactcatagaagatgccagtaaaaaccatagttggaagaggtgaataatggttgcatcattttcctggtaggtgtagccaggcctaaaaatccatccctgctatttataaaatgtgttcctaaggataaagtcagctgctatattgtgaactacattatcaaaataaaatatatgccagtgccttgagtcactgtcccactgtctttacagtgttaaggaagctatatttcatcattgtgttttattgcagtaatatttacccccacttttaatgaacatttttgttccagtgaaaaccttgaacataccaggtttttcattgtgatttaactctttcttttctaccattctgactgcaagtgtctctttgaactgatatttgtgttgtccttgtccttattttgcttttttttttttttttcccccttcctgagatggagttttgctcttgttgcccaggctggggtgcaatggcacaatctcagctcaccacaacgtccgcctcccaggttcaagtgattctcctgcctcagcctcccgagtagctgggattacaagcatgcgccaccatgcccggctaatttttgtttgtttgttttttagtagagacggagtttctccatgttggtcaggctggtctcgaactcccaacctcaggtgatccacccgcctcagcctcccaaagtgctgggattaaagcctgagaacacacaaacagaaaaggctgggaggaagttagatataacatgcaggaggtccacagttttagaccagaacttctgctagggtaactatgtatattatcatctaaacaggaaaatttttagaataaaataaattattactaagtaagtcaagacaatactcatgaaataggattgtttcaggccatccaagacatgtggtcatttatttaaaagtgggatgggtgggaaactgctatttacttaacctcaaactcttcactttcccaaaggcctttgtaaaatatcaaagggggatagaaaagcagtggagaaaatttaaaaaaatttcatccttcaaaaagatcagcaaccaagcactttgagaggctgaggtgggaggattacgtgagtccaggagttcaagaccagcctgggtaacatagtgagaacctgtttcctatatgttaataataataaacaatagaccaggcacaatggctcacacctgtaatcctaacactttgggaagctgaggcgggcgatcacataagcctaaaagttcaagaccagcctggacaacataatgaaaccctgtctctacaaaaaattagcgaagtatagtggcacacgcctatagtcgcagctacctgggaggctgaggtgggaggatcacctgagcccaggaagccgaggctgcagtgagctatggtcacgccactgtactccagcctgggcaataaaataagttccttaaaacaacaataacaacaacaacaacaaaaaaaacccagcaacattgacaactcttagctagtctgtttatgaaaaagaagactacagtactaaaatctggaatgaaagaggtgacagtaatactgactttacagaaataaacagaattagaggaaaccacataccgtatgcaaaaattaacacaaaatgaatcagacctaaatgtaagaactaaaattataaaactcttagaagaaaacataggagtaattttttgtgatcttagatgaaatgaaaacatatgtccaacacaataacttgtacatgtgatagcaacattatttgtagtagctaaaaggcagaagcaacctgtatccatcaactaatgaatagataaataaaagtgtagtgcaccatgcagtagaatattacttgaccacaaaaaagcaataaggtacatgttataacatggatgagccctgtaaacattgtacaaagggaaagaagctagtcattaaagactatatactatatggctgcatttatttgaattgtctacaataagcaaggccatagagacaaaaagtagatttctggttacctcagggtcacaggaagtaggggaggtggagtagtaggggaagtgcctgctaatgggtatggggtttctttggaaggggtgataaaatgttctaaaattgattgtagtgatggttgtataactctaaatatacaaaaagcacatttatatatccactttaagtagatgaattattatctcaaagcatatattgaaaaattatatcaagggtaacaagtttgcgaggatgcggagaaaaaggaactcttatgcgttgttggtgggaatgtaaatgcatccagccattatggaaaaaagtatggaagttcctaaaataaactaaaaatagaactatcatgtgatccatttctgagtatatacccaaaggaactgaaatcaatatgccaaagaaatatctgcactcccatattcattgctgcattattcacaatagctaggagtcaacctaagtgtttatcaacagatgaatggataaagaaaatgtggtatatgtcaacaatggaatactattcagccttaaaaaggggaaaattctgtcttttgtgataacatggatgaatcttgaggacattatgctaagtgaaataagtcaggcacagacaaatactgctcgatctcacatgtgaaatctaaaaaagttgaactcacagaagtagaaagtagaatgattgattaccccaggctagagggtaggggaaaggaggggatggggagttgttgatcaaagagtacagactttcagatagacaagaggcataagttttgagaatctattggataacagggtgactgtggtcaataataatgtattatatatttcaaaataactaagagactaaatttcaaatgtatcaccataaaaaaataggtactccagcctgggcaacagagccagaccctgtctcaaaaaaaagataaataagcaagatgataagatggtggatatgttaattagcttgatttaatcatgccacattttattttatttttattttatttatttatttatttgaggtggaatctcgctctgtctcccaggctagagggcagtggtgcaatctcagctcactgcaacctccacctcccaagtagctgagattacaggggcacaccaccacgcccagctaatttttgtatttttggtagagatggggtttcaccatgttggccaggctggccttgaactcctgacctcatgtgatctgcctgcctcagcctccccaagtgctgggattacaggtgtgagccaccatgcctgacctaattatgccacattttgtacaaatatcaaaacgtcacactgtacctcataaatgtatatagttatgatttgtcaatcaaaaataatactaatttaaaaattacatcaaggggcagttgacctgtagcatgggctgtgttgccctcaaattacatgcacacatatgcattatacagttgttctgtggcaactttgcttttatatgttttacagattgtgcatcccctctctcctacgcacccctcaaccactgttccattaacccataagacgttctttgaagaaagtgtactgtggcagaaaagtagtttgaaaatctctggaaacaatgagatccagaacctcctccagctctaacaagtcatgattctgatgcattgaatttagaatatgaacttggcctagattactccattttaactccgtgtcgactaaaggaaagctgtgaacaaagtcagttttttcccacatagctgcacacaggtgtgacttagtggaaactgtggaactcagccagatctttagctccctagtgcagtgctctatctccaagccctacttcctgttcttgaattcagtgatttgctaaaatagagacacctggttccagcaccttgcaaatggatttttcctttcagcattttaaagtacattcatgtattgatgaagagctttctctggaaagccatctgtctgaaatctgcaggaaaaaaaaaatctccctagctgtcttagatattcataatggtatgtgttgcttcactcctctactcctgcctcctgttcccttttcctcatgttttcattcattttacaaaacaaatatttatgaagcacctagtatgtgcccaacactacatatgtagcagtggacaagactaattagtccctacaattaaggatattgccatctagtaaggaaacatgtggacaaccacaacaacaaaaactttaaagatttttgagtcatggttaagagctatgaaagaaataaggttccgagacaaactatgtaggatgtgattttaaaatgaactccagagttatattgccagtgttcaaattccagtttcaccatttactagctatgtgtttttttttttttaagggggcagacaggatctcgctttgtcacctaggctggagtgcagtggcgtgatcatggttcactgcaaccttagactcctaagctcaagctatcctcccaagtagctgggattacaagcatgcatctccatgccagctaattttttttattttttgtagtgacgggatcatgctatgttgtacaggctgatctcaaactcctggctcaggaagtcctcccatgtcagcctcccaaagatctggtattataggcatgagccactatgcccagcctagctgtatgattttgagcaagttgcttaacttctctgggcctcaatctttttgccttaaaatggggataataatagaaacttctttagtagagttgttctgaggattaaatgagttgatgtacatggtgcacatagaaaagttcctggagcatactgtgcatccagtaagtgttacctatatgttggcattgttgctttaaagaatatcagggaatcaactaattaggttagcattgttatcatcttaatcaccatcatcattgccatctacagatacttatcttgccacatttatgtgcattgtgcccaagatttacagaagtggatataacatgctcttggactcaagaagcttacaatatagagtgtaaggattaaaagaaaattgcagtatatatactaagtgctagataagtgatagagacagcttgttctacagcattgtagggaagagagcagttattgtgggctcataaagagaaggcctctcggaggaaaatggactcttatgagggagagcattctaggctgaaagaacagcacaagtgaggatttggacataggaaggtgaatgtgaagttccagaatggagactttgaatagaggagcagtgaggtgtgggttaaagaggaggccccagcattctggttaaaattatttagtaaacagtaatctgccatgtccagattctgaggtggagtaatcaaataagatttctctaattcacctgaggcctactagtttacatattgccttatttcaggttcccataattgtcatctagttgattgctttccaactggtgttgctacctgcagtctctagtcacctactcccctctgcacatttttatcgcattaatttttctcaaacatccttttgtcactgacttgcttgaaaagttcttagagttctccattgtgcatagcggtgtttctgaaacattaacgtgcataagaattactgggagttcattgtaggtgcagatcactaagtcccaccttcaggtcacatgcttatgacatggtgcctgagaatctctatttaaacaagtgccctaaatgattctgattcaggtgctcaagagtcactgctttgaagacaggcctaaaatgaggagtgcaagtctcttaacctgccacccagagtcttgctttatcctgccttttcaaccacatcttctgttgttctgattaataaaccttttatttgagccaaatgggacattttcttttccatacacttactttttccttacagttatgctcttttttcatcttttgtgtcttttttgtgtgtttccctaagcctcattgtctctactgccatttcaacaagtccaaatcctggcttctttctgtcctggtttaggtatgtccagaaagcatctttagtaaatgagtacatctctaacctagaaggtaggctccaattttaactcatccttttatctactcccctacccaggaatctaatgagcaccttgcaaatgattcccttcatttgtccctccctccctccctccctccttctttccttccttccttccgtaaagatttactgagcacctactgcttaccaatgaactgttctaggtgctaggtgataatgtaggggaaaaaaaaccctctcaaattctgttttcatggaccttacattctcattgggcaactgtttataagtaaatattgaaagtgttctgagagtaatctggcagtgctatatgggatatattaggaatgggagagacctgtgaaagaaattaactaaggaactcttgcaagtggcctttagacagtggaaagggtcagtgagaaagtaaaaaggaaacagcaagagtaattagtgaaatgaaggaatgaccaatagtatttgatgggggccacaaaagtttatttaatagttgagcttttgagaagaaaaaaatgtaaaatggataggtgatgtttttggtaaaagacattaaaaatgttatgatgcattagatatgttgtttatgatgttgataatggggcatccaaatgcttagtagcaattagaaatacagaggtattataagaggccaggcctctctctccttttccccttctccaatttatctcaaaaatcttatgtctgtcttgttgttccaggtccaaaatttcttcccaagaatttgtgtctcattcaattggtttttctgggaatcatggcatgacttcatgtcttagccccatttctctgattgccaaatgtttgtctataaagaggactaggtccaaccctagaacattgtctctaatcatagccttcctttgaatggttctcggctgattaatggtttggcttgtgggaggaactaggaagacaacataattgaactagagattcctttaaaattgggtacagtcgtgagtgtcatgcccctatgggaatatcactgtggtcatttatgattcttagcaaaataggcaaagtttggaaaagcaaattgtaaaagctttggcataacacatagacaggttggaaagctgcttgtaatcatctggaaaatcatttttttccattcttgcagttgctctgactaaaaaaaactcaaattgttcctgactcctgtctttctctcataatactaaacatccagtctatcagcaaatatggtgtgtgtgtgggtgtgtgttttatatatacatatatatattttattggctggcttccccctagaacgtaaacttcatgaaggtaaaagcttggtttttttatatccttagctagtgcctagaacatagtagatgctcaatagcaatttgatgaatgaatgaatgatgtgaaattaaattttatttcacattttgctaattagttttgacattagctctatcttcaagaagcttgggaaatattttatcccaataaattattctagctaaagcccagcagcacaatattatttggtaatattattaaccaaataatattatcttagtgtaagaaaaagtagaaactttatttcttaactagagaaatgtcagaaagttttgaagtctaagaacactctttaatggtgctaatttggtaatagtgttgtgaatgtgatattctaaaatttagccttaaaagacatcctaataagatcagctggtaatcatacaccaggtatgattaaaatttactttttaattcatagtttttaaagaaagttttcttagcagtttggagactggattactactttaatgtttgaaaagatgatgcttgatatttgagaggaagaatgtcttctttttaacctttaaactttattcaagcagttccatatgaccaaaaatatccaagcttaatgtatacattagattaccttcattaatatacagaaagttgctttcttagaacagcaagaatgacttgtgacatatcagcatattaaaatttactggtgctatggggctagctgaccagagatattgttaggaatttttacctgatttagagaatactttgaatttccaaggattgaaggaagaggttatgatcaaagcatttgtgtggaaggtcattttggtgtagtgattatttttatggagtagcagagaagaacaaagtatttgtaatggaaaagaagaattggctgcagggcataaacaaatatttctctctaacatcttagccattgcatttcaagtctgttgcatcattactttttaaggtattgataacatatgacagagagagaatatatggctttagttcagtttaaatatgatctatacaaagtaaagggtggctaatacaagtttgcaaatgactttccattctgttgggtcttgatggatttccataaaattagttaggtagtagagaatattgagacttgggtttactttgaagagaatctagcattaattacaccaggttttttaaattaaatagaataagtaataatgaaaatcaagtcaaatatttctatctggcaatgaaaaccagctactggatgaagttaattgcttgaccattgtcatcactttctcaacttgtactgaatattgggggtaaattagttttaaaagcatgtctttttcttgcttcatttccatgaatcctacataatttctttaaagggatatgtatgatttaggggataaagtaatcaaataaggatttgtatgtatttcatcaatagaaatttctccaagttcaactatagttttcttatcaaaaaattacattcacagttgcaaggcagaggcccactggaatagttaataagcacagtcgacttctatattgctgcagaaactaaatacaaacttttctgtgacttacatataggctcggtaaactttcatctgcttcagggtcagggctgattcaatcttaaagcaagtttatgagagtggctgatgtgatacagttgtttctggtaaaatcagactagctctaaggagccaatctaagtcagtctctgagtcaaattctatgaaaaacagactccaactcagacacaattgtaaaccctaatataatgaggacttgcagctgatttaatcctattgaaaatctttaagcagctatgggacaaaatggtttccacattgacatcagtggaatgaaccttggatttcatcagtctgaagagtagttaccctgtacacacagtagccactttgtaagaattaacatcatggccatttcaaagcaggttgttgtttcttatgtagaggcatctgttttgattaaggtccaagttgccagaatgtgtcaggtgtgtgtgtgtgtgtgtgtgtgtgtgtgtgtgcgtgttttaactgaattcattacaaaaagcaaacaagtcaaacttaaactcagagcctagtataaatcaattagatccagtctccttgaacaaaaatgaccaacctattcctattcactatatatgtgagcaacatagagaaagaacggaacagagaatgagaactgtttttgagttaaactatatgcaaagttttgcctggaactaattatttttttcatgaacttagaagtccctgaaaataagcttatgctgtgaaatcatatatgtataaagggacaaacacacacaaaagtctaaaggtcaacactgcagataaaatctcaacaggaaggttttgaacttacctatgtgcccatgttggtaggtggatacatatactttttttttagtttatcatattgaaataggcactgataatgatctaggtgttatagtcagtttagcactagtcttagttccttttcataatttacaacttaaattagaacaatagaccaaacacagactgcagtaaaacacaaccttgactgaactatctgcatgctgcttttattgcagttagcacttagcaggcagtagtggcctcatactgttacttcaaagagccggaaaagtaacttcatgaaagggaaaacttgaaactgtagtactctttatctttctgtctgttaagcagtgatgggtatcattagttctgctcttttgcataattactgcagtattgtgaaaaacatttttgccattcaactgggaacaattatattatttgagatcttgtatagcatttagttttagagaaataaaagataaaaagcccttgttttctagctctgggtatctgtagtaaggtagtgcatacagtgcttgttcaagtttgtttatttttttcattaaaaataacattaattggtgacactaaaggagacatttcatattgaagtcaattctttttgatgtgtttttgtttaatgtgcttgctaagataaatttcatctagcacatcactgagttgagatggtaattcattaataaaatgataaaggtttatgaaccataatatggacatcattgaaattttgagacttaaaaatatattcttattgttgtctagattaaattaatacaattttctatttatataaagcttccagtgtagattatctctgttaaaagcatgcgacagcctctcccaaccaccccaccctacctcatcccacaaacttctaaagcatagagctagaagtatgtttgcaaatgtttacacaatgaggtgcataactttttcaagtttgtaaaaattctcctttgtaatctcagtatgtgaaaccattaaaatactgtaactttttttactgtatttgttagataagatgttaactttttggaaaatactactacattatagcaagggcggtaaaattaggatgaagatcacagttatatatagatgtgattgtcactttgattctgtggttttacacttgactttttataatttataagatatgaaatataatctcataattggcaaaatatattttgatcaaggaaaaggtatgactgttgcctgttggaaatattacttcagcacggctattatattaccataattatgataggaagttagaagaaattttggatatgcatatgtttggtatatagtaagttttcttacaaagacaaaaagattaaaacacataattttaattaaaagcctggaatagatgctgaatttccttttcttgtcagccatcaaaacaaaaattgtatttgtttttgtccttaataattctcaaaaggttggtttccacaggtttttctttaaaattttaagcatccatttatttgcaacatttttattaatgagctgacatttgaatatgttcataaaaatgttgatatggctgaacaagaagtttcaatcaagcttccccaaaatgctactgaagaacatctaattaatataacccaaaattagtttaatgcattccttggtattgttgcattattcaaatgtggttttatttactactcctgagacactatgcctcttaaccaaactccagagtgagctggtaaacttacctatcttaatacattgaaaagaggaattagctacagttggttagctaccagtacggctttcagcaccttctccatggtggctagtatctgtaccgtatacagctgtgaaaggatgggaaaatgcgctgaaatgatctaagaagtaaactatcaacttgacatgttttcctagctattgaaaactgtctcatattgaaacccgttgatagtgaaactgtagaattccactgatttaagtaccatctggttgtgctcaaggctttaaagctgttatctctgcataaaatttcagagtcctatacttttttcttcaccaaactatccatttttaagccacaaatatttttccagctctctcagattttatctaaaagtatattttaacagcatttaaatagttcttaaacaataacaatttatcttgatagatggcatgctgtattttttcattttattttaattagccattgtggaactaaattcccttttgttttagtcttttgaatattaattatcattatcatgccagatatcttaaaggttattttaccaatacagttccatttaacataacccatatggaatcaatatcccagtttcctaaagtgaatgcttggaaaatcttacattcatatgttaagagtacacatcctttcctcattagttggaaagtacagggattttggcacaggttctgtgtggaagcattgtgcagcttttatatggattttgtttttagcctttgatgacactgtttagaataggaagtatctaataagtaaagcattttgtctcaagtgctgccagtgtgtttaatatatgcctggaggtctgaaacattatcttcttcgatacagtaatatgcatttaattctctgaaagcagaaggtcgaacttttgaaagggacgcaaagtacattttcaaacagaataattcaaaacatatggaacagaggaccgaagtaatgtacagttggtttttatggcttaatcatgatcatgttaatgcacaccagtagctaattaaagaaaacttttattgttcatcttaaataagttaggtaaagagtgggagagctgatgtaacagcactgcccagagatacatgtttctgctgcaccaacagcaagcagatactgctatttttgacaacttaaattattagtccccttggacaataataaagcacaagttactttcagagttattatattgtgaactcttcgttttccacaaaggaatagtaaattgatgcccaagtttagggcccagcacacataattaattataaaacttttcttaatagtggaccagatacccttcaatatagtaaatctgcagtggactggtgacaaaccagtggatttttaaatatgtctcaaaatcatcagcttgtttacttcagtgctacagatagtttagaggcttaaaaaaaatggaggaaatcctggcttttaacccagttttaggaatttagttttctagtactgggtaagttgtactttttcttttccttccaatgaaagccagagtctttcatctctaggtcattggttcaaattccattctgctcagtagtgattagaattagttaccatctgacttctgttcagtaacctttgtgacctgagctgatagctgccatcctgccactgctggttatttatagctcaagatcacaccacttgacatttgctggagactaatgtagcagtctcagcacataatataggctggatgctaaatttctttacctttctctacaggtggtttgttgttttatgttaacacctatgggaacacttaatccactttaaagagggagagagtagattttaagtataaatctgtaaatcagaagtaaaaaatgctctatgcatagaaactatagtttcatttagttaattgtggttgactttcctgagtcaaagaatgaaaatagcttataaagcttgagttcttgattggagtttgccatggaactcaacctaaaggattttttagttatactgtatttagatatttagtttgtaatgcctcaaaatatgcttgatttcacatttgactgcttaagtacttgatttcatcacttttcacatgttatgtgagaattcctagttggtaatatatttggaggtttatttgaaattttcataataaggataactaaaatgaaacttattttgataacaattatctttatcttactgaatttttaaatatgttcatacatttattcagtcagcacacaattattaagctttattatgtgataagcactatagtatgttctaggaaaactaacatgatgtttcctcttacccaaagcctgctagctgtctgaccttggaactattgatcaatctctataaaactcaattttctcagctgtaaaatggagatagtagtactcctcctcaaagaattataatgttagcttatgtaatgtgctaacagtgtctggcaaataataaacatactcagtggtattttattttttcttcaattgctcacaatccctgagacagaatatagtgtgaaaattgctataatattagtttgttataaaagcatagcagtgggaaggactagcaccacctggaagggttgctgaagtcttcacaaagaaggtgaattttttaacttaccctttttagagtgcctactgtgtttgttcaatatgttaattaattttatgctgcagcaaccctatgagttaggtattaatgtcccaatgtgaggacacagacggaagagataggattctttgaagtatgatcagcccacaaggtagagtatgcagatcaggaaagacactatgaatgactatgtctggggaagaccttaaggagtacagtattgagaattctccatttacatttctttatatcgtaacaatcatgtaactctagtctgctgggcaattttttcatttaatgttgtatcaaagataaacatatcaaacattcgtggattctcttcagtgtgctaggcactgccctgctcttcagtgatatatagaagcagaattgtatactccattccctctaacagttcttcacctggtaaaagagacaaacacataacagctgcccattgttggatatttactgtaaggcaggcactgtgctgttcattcagtcattgcagtaactctctgaagtaggagttattatcctcattttacaaatgatattatatagccttagatttgtaatttgttcagagtcatacaattagagagtgttggacttgatcccacatctgtgtgactacaaagcctatatgttgtcttaacactgtctgatactgtcaccacaaaacattttagtaaaatatatcatataatagaagtataagtgaactactaagatcaccaagaaggaaaagagtgagagaacagttcttggacaaatgtcacttatcttgatggataactaaatgttcatcggctacagcaagctcagaggggcactccaagaaaggaaagagcacagtatagactgcatagtttgaaagaatatggtgtcttcaaaggacagaaacaagtcctttttgtttcaaatagctaatgctggatttctctaacaatgtgactttctcaacaactataaaaaccaattaacaagaaatattcttaaaagaattttaatgaggattacctcactttcttgacttatttattcttacataagttgttatatatatataagttattgcatatatatatattattatatataaaaatatgtttttttttaccaatcaaattaaggagtttttaaaataataagcagctttgggaggctgaggcaggaggattgcttgaggccaggagtttgagaccaggttgggctacactatgagacctcatttctacaaaaaatgtaaaaataagctagccatggtggtgcatgcctgtaatcctagctcctccgaaggctgaaatgggaggcttccttgagccaccactgaggggttgtaggctgcagtgagctatgatcacaccactgcactccaacctgggcaacagaacaagactctctctttaaaaatagtaataataataataataataataataataataataataataagaagaagaagaagaagaagaagagaaaagaaaagaaaagaaaagaaaagaaaagaaaagaaaagaaaagaaaagaaaagaaaagaagaagaagcaatacccagttacccagtactttgggagacattttttatcgctgatagtaatgtaacttagtgcagcctttttggatagatgtttgacaatattcagtaactttaaactttttcgtaccatttgcctaataattccactttttaaaaatatttttgtttttgtttttgtttttgagatagggtctcactctgtcacccaggctggagtgtggtggcatgatctcggttcgctgcaaacaccacctcccaggctcaagccatcagcttcctaagtagctgggaccacaggggcacaccaccaggcctggctaattcttcatattttttgtagagataaggttttgtcatgttgcccagcctggtctcgaacccctggtctcaagcagtcttcccacctcagcctcccaaagtgctgggattaccagtgtgaatcactgcacctggcctaataatttcacttctaggagcctgtctgtcctgagaaaatattactaggtgtttgtcagcactaattgaaaacttgaatatccagttatatgggaatggtagaacaaattgtttctaacactaaatgaaatgttatgcagctttaaaaattatatttatgaagagtacattagcatgtcaacatttgagttatcaatttgtccctatggtatcattacaaccataaagggatacaagtgaagcaaacctgtgcataggtaggaaacaaagactgaaaggaagagccatgaaatattactattggttatgtttggtgataagatggggtggggtagttttttttactcttatggattttttatggttaccttaataattctgttgaaaaagcaagtaaaatatctaggtgcagaatagcaagttgcagactgatggttaggcagtctaagaaagaggaactgatgttcttggagccaaatgattataactcttgctgccaccaagttgctctttgttctatacatggggagtcattggtggaaaattttgagaactagtagcctttattgcacaaaggaataatctaccctcaagggtttaaattacttaataactgacttgattttactttatcacttatatttgtccttgttttaagtcctattgtagtaggagaaaataaacatcttttgaaatggcatgcatttattttagtgtacttttctttgtccttcataatttaggactactgatttttccctttcttactgtccaaaaacctataaatcagttttataagaaaggtaaggagtatagcataaactacttctacgtaaaatgtaatttcaaccaccagtaatcatgattttgcagacagtttattatattgcttgagaaatcactataaaagtatgtattaaaataattctttaaagagacattttaaaagatatatgctattctgtattaatgcaaagaaagaagatctgacattcaaaaatatattttaatgatggaaatgaacattagatgctttttctcaagtatttccttggcatttttaggtgattttaggggtctggtgtagaaaatgggcacctattctatttttctgattactgttttaagttatactagactcatttttaaaattttctctttgacaacatgtttatataacattgtttatatgacacttggcatgtaactagtttgaaatattttattacttttttcttacagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtataggtaagaaccttcaaacttactggagtgctaataattactatctaataagttgtattcccatagtttccagattgattaaacagaaacagctggcagacaaaagtcttttctctacagaatatggaaagttcatgttccacagctgaatcctgtttaagtaaatgtttgaaatgtattgaggtttagcttagtattcttactatgcctctgaatattcattctttttccaggaactgaatgaatcaggaactctttcttgactatagagatgcttaacagtttccagtgtttggaaagcatagctcgttttcatattaatggcccataggtatgctttccatgttaatgcttctattcagattaaaaaagaaaagccttagaagatgaagtttgtttttggtattcttttgatgtaatcatcttcatgcaatagcatcgtattaaatgtaattgagaaggtttattaataaagattatttaaagatttttgtacatctacagaaaatatattgatgttggctaatttgctcttgctgcccaacccatcccttccttattctaattataataattatatgaaacttccgaagctttttgcctgttgagactaggaaagtgagcagggttcagatttaagacatacaagttattaagtaacaagggccagtggagtcaagcaaggtgacagtataccctttccctgagttaatgtagatttggagatttggccaaaaaaaactggagagggtagctgggtcacctaagattcagtattcaaagagggctctagcaagctcaggaatagttcaggcattttattgctttcagctggtcccatccagtaggtggaagccagcagtgaggcattcagacaatgtatctaatctggaattcaggtttgttcattcttgccattaagaaggaccattttgcacagcaggatcctgaaaggtagatggcaggtgtgggaatcaggattcagcctgaggaaataggatcaaaggagctctaggccagggtttagtgcaagtcccctgctttaagaaaggggtaactagccagttgctgaggagtaacctagggttacccccaggctgcttgctggccctctctcctgtgcagctcataatgggtcaaaagagctgattgttagactcaggaactttgcaagacagttgttaaactactagtagcttaaattggccatggtgaaagtatttatgccgcagatgcttgcaaactcaatcatatcagctctcctacaccaagagccatttgttaaacccttaccagcaacaactgcctctctttctcaaatatattctcatttactgggtgcctgtgatataacaggtacttcaggggcaatgaaaatgtgggagatgctggtatagtggaacatgttatgtgattcaagaactcatgcctatatacctgatacctgcttgcaagtctgcttggcgttagccaaaacttaagtgcaggattaggagatgaattcttaattctcagcccttcattaagttcactcagctacagtcgctctataggtgggtggcccgtactaaaaatcatcaggagaggcagaggaaagtaggagggggaaaggggccgagaggaacagctatgacctcttcctaaatttgtagatatgcagagatcacagaagcctcattttgcttacttcaagcccaacctaaggatactctgtatataacctcaacctttgaaattgttaaactgaggcaagccagggaccacagtaatagaaaagaactgccaatgatggacttgtttccactttctgaaattgtaagagaagattggcttcagtctgttttattgatatactcccaaatcatgtgtttatacattttcatctaagtctgtattcagcaaagttataagagctcataccaaagataggcatttgaattataatcaattcctaggttaaaataatagaacacttgtttaaagcggggaaaaaaccttgtatgtaaactgacgtggaacccaattttggtacatgaagctagagtggtggtcatgggctagatttaatataggggtggggggtaaatgtaggaggaaaaaggctcacatactttctaaggagcattttctgcataatattctcatggatgcctttccctacacagaatgcatctacttgaacatttatattatctcagtagtatgactcctggttagtaataagcaaaagttatcaatatgcatgataatatttcttaaaaatgaacttagtgatctagggaaatttttttcagaagacccaaaaggaggcaagtaattaaaatacaatggctaaaaataaaattcaactagcatttattgagtgatcaccctgtgccaggcattgtcctaactgctttaacgcattatctcatttcatgctaatgacaactctatgggaaatgttctatcttagagattaggaaactaaggtttagagaagttaagtaacttccccaaggtcacagacctagcaataaacagagctacaattcaaagctaagaagtgttggactcctgagtctagactctcaacctctatgggtcccctgaaaagaaggatctgaattggaggttctctcagtcagcctctattgtcccacttcagaccatgcaaaagattcctgtctaagttttaactgatgaatttttatgttaactgtgtctgtgatgtgattacacagtactcaggtatggaaaacctgggttcaaattctgtcacttatatgtatacctatatcattatgcacttatggaaatgaaaagagataattcatgaataattctaaagtacttagcattgagccagcaggcctaggccctcaaaaatgtgtgctggtactattttagctgtcaatatcatatagtgaaaagaatacttaactaggaggcagaaaacctgggatttttattcatggccctgccatcaattagtaaagtgatcttaggcagtttactctttgactttctgttttcttatctgtaaaatgtgatgattataatagatatcaacaaagtccattccagttctgaagtttcatcattctgtaatttggaattctgtaatttggctttggcttcatggagttgacatctgtaaggctctgcagtatcaggtagaaatttattttgatttgttttgaagatgcagatttcctttgatattctagtggagctctaattagtttattcagagttttaaatatataagttttattaaatgttaatgaaattatttttcaaaaactgatctggaaatgtgttttatatttgtccacttgaatgaattgtctaagtcccattaccaatttggctatccagaaacactttatgtagtactttctttcctgaaaaaagcactgttccataactggtgttttctggaagccccaagatagtaaccttaaggataagaaaaaagagaaaaatataaatggctataatgctaactttcatggggagggaagcagagagagcagtaagttgggggtggctagctccatttctgcattctaaagtgaaggagtcattgcagtgtctttaaattggagggactaaaagagatattaccatgaagctaatgttctaagaaaggtccaggaaaagttaaaggcatcataagttaaaagtgaaagaagtaacatgtcatgtgtttccacagtgttcatatgttttctctggatattaaaattctttttgggtgggcacagtgtctcacatttgtaatctcagcactttgggaggccaaagtgggtggatcacttgagctaaggagtccaagactagcctagacaacatagtgagaccccatctctacaaaaaattacaaaaaattgtaattgccaccagttgcagtggcatgcacctgtagtctgagctattgagaaggctgaggtgggaggatcacctgagcctgggaagtcaaggctgcagtaaaccgagattgcatcactgtactgcagcctggatgacagattgagaccctgtctcaaacacaaaataatttattcttttctataaggtaactccagtggcaactggccaatagcaatttttgcacatatgtatgattgtatgatttggtttggatgtttatcccctccaaatctcatcttgaaatgtgactctcagtgttgaaggtaaggcctagtgggaagtgtttagattataggggcagattcctcatgaatggtttagtaccatccttttagtgataagtaagttcttgctctgggttcatgaaagttgtggttgtttaaagaatgtggcgcctccccactaccttgctccctctctccccatgtgatgcgctggctttcccctttgctttctgccgtgatcatagcttcctgagacctcactagaagccaagcagatgttagtgcagtgtaccgcctgcagagccataatccaaatatatcttttttctttgtaaattactgtctcaggtattcctttatataatgcaaaaatagcctaacataacacgcatctcaataattgccccattgtcacatttcaaaaatacctgtgaggttgttatagagatattggctttctgggttgttttgttttgagaggacaataacatttgattattaaaaaaaaatcctagcacaatgtggcttgtcattgtttattgttttctatacaagtcataaaccattattatatgtgctcatgttcctttatatagaaatcatataaaaaaaggattttgttttactctttaaaaagttttcatggctgggcgtgattggctcacttctgtaattccagcacattgggaggccgaggtgggcagatcatctgaggtcaggagttcaagaccagcctggccaacatggttaaaccccgtctctacaaaaatacaaaaattagctgggcatgatggtgggtgcctgtaatcccaggtactcaggaggctgaggcggaagaatcacttaaaaaggaagaatcacttgaacctgggaggcagaggttgcagtgagccgagatcacaccattgcactccagcctgggcgagagagcaagactgtaaaaaaaaaaaaaaaaaggtttaataattttcagaaaaggtaaaatcatagttcttatgtaactataaaaagaatatatgtcaaaggttttatttaactaataatttatttatctcattaatttgtaagaatatcacaaaaaaattcaggcacaggggacctacacagataacgctggttatctcaagagatttttattctataattcataagggtcttaaaaattgtcactcgatcatgggcattattcattattaaagtatggctctgggtgatgcttctagaaagatggaaatacttttgacattaaattatgaagatttggtttaatttgacatattcaggcaactataatgaagagcccaaaagtgaatattgaaaatcctttgagtgttgtaggaatacagtgtaatataccaaggtgactactttaatcagtctggcttttaaaattacatcttccctcctgtcttatacaatcagcttgacttattacttcagaagaacatcttattcctattgtgctttcatttatacagcagacatattttgggaatattcattcattcgctgaatgtgagcacttgctgtttatcagacatgggcaagactctgagaaaccagtaataagactcagtttctgccttcaggcaccttgcttcatgtgataaccatacttattaagattaattttgaaggtttagcagaataaagatcttcatgccatggagggttgtgaaacacttacattaattaaataaagcctatgacctttatttaagttccagagaagcaatttagaaaagctagtatcagttgtatgtgatggcttaagaaaaactgtttagatacatctttaaagttattgattttttattagttgtatattcagctttagctgtgattcagaatatttttaaatattttactttatgaatttgccttttggctatatttctttgtaatatattttagtggttgctctggggtttccagtatgcatgtctaatcattcacactctatttagaggtaatatttcatcacttaaaggaagatgggagagctttacaactacataggttcctttactgtcttccatttataattgtcataaatattacatctatatattcaaaaccctaccagataagattttaatctttgtttcagtaatcttatatattttaaagaactgaagagggggaaagtggtcttttgtattcccagccatttaccatgttcagtgctcctttatccccagagctccaggtttccctctggtagatttttcttcagcattaggaacctccttttgcatttcttttagagcagagctgctagcaataaatactgttttccttcatctgcgagtaccttttttttttttctctcattcctgaaggatatttttgctggatgtaaaattctgggttgacatgtcttctagcactttagagatagtatttcatgttcttctgtcccctgtggtttctgatgaggaatccatgttcattccaattactgtttccatatttgtaatgtgttgtttttctctagctgttttcaagacacctgcttatctttagttttctgtaggttgattattgtgtgtctggacttggtttctttgattctatcctgtgtggggttctctgatcttcttgactgtaaatttatgggtatattgttttggttttgtttatcaaatttgagaacttttggcccttttttcttcaaatagtctttctgcaccaatctctttctcttctccttttggaattcaagtgttaagctttttaatattgtcctacaaatctctaagactctcatttttttttccccactcttcagattggataatttctattaaatttttcacttctaaaatttccatttggttcttttttgtagttcttatttatctgttaagaacttatatttcaattcatttcaggtgtgtttacctttacctcatgaaatacagttgtaacagctgcttaaagtcttaaatgcctgtgtcactgccaccactgtaacagtcccctctacatacacacacacacacacacacacacagacacacacacacattggatattgggtccaccctcagggcaaagccaggagagagagaaaaaaaaagaaaagaaaaagcaacaagatttcccctacactcttaaaaccacaggggacttaatttccagacaatattcctgttggagctttggatgtgtccttaccttcactgtgcaccacaatatagggctcactctcgagttaaacttataaaagaagacacaaaacaacatgaactgggaaattcatcacaacgtcggttatagccacaaattggactttcctctccaatctgcattggtctgatttacttttcagaattctcaggtatttatttgctttttgtgtcttttacaaggtttttaattgtaagcagcatgagagttaggctgcagtgaggttattccagtctgggctggcaccagaaatcctgccatttaaaaataataataatgttttctagtccattagccaggacttggttttctgggaaacttaataggggatttcctctaaaagtgatacttttatatctttacatcttgagcacagatcagctacatatagcctaatcagtaattactgctcccaaggagttgtcagcattaacttgattcttcccgtgtcaccaataagcacacactcagagggcagcaatggtgttctctctctgcattcctcagggctttcctttcatatactatcaaatcaagttagcaggggaaaatgctgtgagattcattgcccttcttgtcaacctgccttccccagcacatgtgactgatatatacaattttaaaatatatatgtatagttaaatatatgtgtatactctgtagtgatgtcccttatccatagggaacatgtttcaagatccccagtggggcctcaaattgtggatagtactgacccttatatgtactgttttttcctacacatacatacctatgataaagtttgatttatacatttggcacaatgagagattgacaacaataataaataacaaaataatacaattacaacaatatactgtaataaaagttatgtgaatgtggtctctctttctctctcaaaatatattttcagaccacaggtaattgcaggtaactgaaaccacagataagggcaggggattactgtataaaattggccctcagtattcatgggttccacatctgtggattcaaccaaccatagatcaaaagtattccaaacaaaattgcatctttacaggacatgtacagactttttttcttattatcctctaaacaatacagcataacaactatttacatagcacttatattgtattaggtattataagtattctcgagatgatttaaagtatacagtaggatataaataggctataatgcaaataccaggtcattttatatcagggactgggatatctgtggaatatggtatccacaggaggtcttggaaccagtcccctgtgaacaacaagggatgactttaaacatatacatttaaaaacgtatttgagatacttcccaggataaataagtggaatctatacctacatctaaatctgttttacaaagctaaagcaaaattaaaagtatgataattataattttgaaagtcctattaatagagtataattcatattctgcataatttactggtcctaaattatgctgactgtatctttaagctatacatagcaatatgcttttcatccttaatttaaaaacattgtttaaaaactaaattatcaacttgaatttttaatgaatattaatattaataatctacttcaaatgattttccaagtagatagtaagtctttgagttaacttctttttagaaatattagactaatgtggcaataggcttttccatgcccttcccacctggagcaacctctaacagaaatgagatcttctgccagcacctttatacatagcagctgtattattggcagttctcatttaaataaagatgtatgtagttgtttttagcataatcgtattagttgtgtttataaatatttaaaaattggtatttgttttgtttaaggtaatggagtccagatttgaaattgcctcatgtcttgactatgcagcccaaggcagcctcaaaaagtcatttttcttcttgtttgtttggggcttttttgtttgtttttgaagaaatggctgtgccatctggtcaaatgtgaagggattgaacagttctgagggaatttaactaactccttagtgcaatatcttgttacccattaatgtgtgctaggacctaacaaagaaaccaactgaaaacatttacttctgccatcttgcaacttatttacctgattgtatcttttcaaacatcaactagactaaaatacagaagttaaagtttatttgaatgtatcatactgaaaaagtaggtcatagcacacttctgtgtaggatactgtaatgtttaagataggttatctaatatgggacaatttctgcattttgaagttttataaatgccaaaggtctaatgaagggtcaaacttgaaatatggagtcctatgagagctcaggattagacctctcggtactaagttttaatcctgattctactccttacagctgtgtgaccttaggcaagttatttaacctgtttatgcctcagtttccttgtctatgatatgagaataatactggtagcagcctcctagtgttgctattaggattaaacaatgtatgcgaagttcttagctaagtgtatggcacaaggctcaatgactattaataaatattgttgcttttgtcatcattgttaatatctttaagtgtttttttaaagtagtggttgtaaatggtaaaataatgcatatcatttcaatgtaattctagctattgtggtttgaaaattttcagttacagtaattgagggttttttttttatcctttcatgaataggactgtagaaatgtgccaaagacatttgagtaaacgaacagttgaaaaatcataaaatggcttcttacacctcataaatcatatcttgatttcatttagttattgtgactttaagaaaaagattgaattatatgcctctttagaattaaggtttttgttaatatccctggaaaggcttagaattaacctgtgactttaatgtcataatgatcacactctgaacatttatctggaaatttagctgctgtgaacattgcttgctggctaataatatgaaataaaattattactttgacaggaattagcaagaaagtagatctcttaaatgagaggcattctagtgtatcactcagagagaaaggtgatgagaaggttaaataagaaatgacccaaccagctgagggaaataatattatatgaggaagggtattagaacagaaatcagaaatcttgacttttagccttggttctaatgccaaagctctttcatgcaaacagctaaatttcttggtgctttagttttctaatctctaaaatggtttgataatatctgctgttagtcaattaatggttaaatctgagtttcaagtgaggtgatatttatgaaattaagtggaaatatgaaacattattcaaacataagttgggacttcagtgattattagtattaaaagggaaactttcatttttagacacgaggaaaagattagtgccctggcctttgtgactcccattgtaatcatcaacatttacttaaaacaaatgaaaatggggggaatcatttaaaggcagtgattagctttaatgttacaaaacccaactttgcttagagcagaaaagaggtttacagttgggattaagttgatcttccttggatatgtgacttcatttttttttttttttttcactgaatagcaccttgtgcttacttgtgctgaattttaatcaaatgttggccacattagaatttaatatgaaacaaccaaattttaataagaaagagatcaaggacaacacagagcagcacataaaatgaattaaaaggaattaattgaattgatatttcacatattatctgctggttatacttaatattcattaagtataaagaatacacttccttctagcaagatatgaaagacttggttctaaaagtaagagcaagtggacattgatggtcaaacattccagcagccaatttaatcccttccttttcctgttactatggactgcagacctggggtttcaaaccaggaaatctcttgcccttcccatcacatcttacgaggtgcagagtaggtacagaatcgcagagcatgtgaaatactgcttatagagttagccaaaggtctggatatccacagggagatggtggcacttaccttgcatccagagcaatttggaactggtttcttggttgatttttgctgtcctgacattggatgatgatgatgattattattattattattattatatatatttttttgggacagagtcttgctctgtcacccaggctggagtgcagtggcgcgatctcggctcactgcaagctctgcctcccgggttcacaccattctcctgcctcagcctccctagtagctgggactataggcgcccgccaccacgcccggctaattttttgtatttttagtagagacggggtttcactgtgttagcaaggatgatctcgatctcctgaccttgtgatccgcccgcctcggccttccaaagtgctgggattacaggcgtgagccaccacgcccggctgacactgaattattatgatgtttaatggatctagattccttcacaatttaacttgcaggctttatagagccttcatggactacttttgcttttgtggctacataagaaaaagaacaaattagccatttaaactatagatcaaaaagtaaatatagaaaatatattttctccaagtaagtatagaaaaatgtatgaaactcagtaagcttgtagcttgccttttacatgtccagtggtcaagaagtgactgttctgatagtgacctcttattgcagaggattacacttgaagccgttgagcatagccaaaaccattcacaactttggcctctggcagaggctgcttgggagctttaataacatcaatttcatagatagccacaaataaatgtatcatactacaaataaatgtagcatgataggaatttccaaaatgctgtcctttaaattctctgtaagttctattaagaaacacctttatttgttcttggctggggataaaaggattaagccaaaaaaaaaaaaaactgtctaggaacaacttgtctcaatgaattgggacacaggaagggagagtaaggaatctctaagcactcacctgctaccctaactcctctttaggtgtttcctcctaccctactctagctagctgcttgatcatccttgaaacagaaaactctttgaaatagaagttctgatgttcacttgtaaattattttgaagtctcatttcagtcccttctttgaataaaagttgatacacccagacacctttggaaaaggaatcagcactctaacttctagtttagaaaatggaaagcagtctattttggcttgcagattatttacttccttgatacaacactgaatacataacgaagtccaattacactggatacttctaagtgctatctaccagagacaaagagttttgatactttttacaatatgaataaagagcactgaatcttaaaaagccaagtgtcataaaaatctgtttatttcaaagtaaaatatctattataaaagggaccagagtgagacttttagatcaacatcattttcctctttattctcccttctcttcttcgtgtccataaactgctgttgtgttaagtgctctcttggctgtggtaggtgctgctatttcgcatttcactggtaggaaggcatagggagtcccgaggaggtgggttaggattgtagatggaatcagtgggcccggttagtgatttgaagtgacagccagtctttgcctgcttcctagccttccaaaccaaggtgtctccatccttcccatcctctgccccagctggccttgtcagatgcttttcctcactgtactgtctcctccctgctttcaggtgctgttaggttccaagcataaaaggttaaaaagaagaagaagaaaagaagtgaattcaatttcagagtttcattttgagttggctgcactgaatcatgttgtattttacacaattcaagtagtaaccaaagacatacttaactctatgaatgtttgctaagggttaaaagaaatagtgagcagcacttcaaaagaccacttttatcagatttactggaagccctgccaaacaattaagtgaaatgaagggttttttctgaagaagagcaaacctacaaacaaaacgaatgcagtcttaatcaagtcttcatgaaagtcttgattcatctgggaactgagttggggctttctgaatcttctctttaggtattccttatgacataatatgatgaaatttggagcagaggattgggattttttggttttgtttttctttgagacctggtcaacccagaagaaaaacaattattacagctttgtcaatacaaatgccttatgaaagtgaaatcgaactcactctgaaccaaatttatggctgtgggcagtttgtcatttattctgacacatttcctaccttctgttactcctcataagataagactttctcctgtttctttggcatagggacaggagcgtaaatgtgctcatcaacatcagcaggaatttattatttttgagagattcctatgacttgaatacatccagaagaggtctgaaagagcttccaatatgaaatagttatctgtttgtcactccatttatattacattcataggctcctttaatcttagtttatctggtacattccccagtgtgttgaccctgaagaatgtgtaatatgaatcctatattgtagacctgatgatggaattaaggagaagttaaactgaggacaggacaggaagactaggagtcatgcccctcattttctagccattagagcataagggactaaagggtgacttttgaacttgagccgtttctctgggattctgacacacctttctgctactacagctgctttcagagtttcattttgagctggctgcactgactcatgttatattttctatgatttaaatgataaacaaaggcatacttacctctatcaatgttaatgactacaggcatatgcgaagtagagagtttagcaaaaactgggaaaagggccaccagccctatcctgcattcaattttcattaaccatgcaacctgtatttttctggatgttcctaatttcagttattctgttttatcaaccctgtaaattcaggcatactttaaaaacccgttatattaatattttgttgggaaatagtcattttggattccttggatggatttcctagacttttacagttgctttaatttctaacttctcctgtgctttctactatggccagttggtttattgtgtctcctattaagtcatctccccctgtaattgcccagagtagactcctaagcttggtgccagatggtcaggtcctctaacttgtgccaaaagagaggcaactgcacaaaacccacttcacttaccttgaaaactcttatctacattatcagactttgctattcccccagtttataccttgagaggagggcatcaaatacccactaagtgttttttctttttccctttaatttttataaatgcttggtaaatagtgctattttgtctttaagtcctgaataacttataagtcagcatatgtttaggatcatcctagaggtgatcattcagcagtactttaaaaattgtgtgtgtgtgtgtgtgtgtgtgtatgcagatagattttttacatttgaatttactgaatctgtgtcctatttcattgttttattcactgatcaatatatttttaagctcttctcttttagtatatgagagtcacaccattctcgttatcagtagcatagtattctatgcagtatttatggtgcattcatagtttattttatatttatctatagatagatatttagtttaaattttcccaaattgttaatatttcaaatgatgttgcagtcaacttctttggacatttacttatatattcttaagtgtttctttaaggtacagtactaaagacggccttcctgattccaaggacatgtacatttataattttgataaactttcattgtcaggcttctcctctgctcatgcaaaaatactgcatgtacacccttatcaaccatccatgggggaatttgtttcttctccttctcccccaatataagatattatcaattttttaaatttatgctaatctatggaagaaaaattgtatttcttgttttaatttatatatccctgattaagaatgaagctgagcagagttttcctatttttcataaagcagtgctctccaggaggattcaacagctaaaggtaaaaccaaaagcttaaaaatgctttaagaaactataggaacatatataattacctaggaataaattcataaagtaaaagttaacagattttttttaccatatgtgtttaaaaagtatgcgtgcaaaaagcatcagaatacagttaaatgactgcctcttcacgtgaggaaggctttgctaaataaggcaaacaaaacactaatactcagaatatataaggagctcctacaaatcagtaagaaaaagaactcaagagaaaaatgtgtaaataaattctttgtagttgaggaatcctgaatggccaatgaatgaaaatgcttaacctgcttgctttttttcccctgttaacaatataaaataactgtcttatgtcaaccatatagatcttcttgattctcttaaacaattatacagattatttatttatttatttatttaaacattaatctgttgctggatatgtaggttgttttctatttttgctatgataattctccagtatgtttatttacacacttacctgacttcttatttggattaaattcctacacattaatttcctaggtcaagtgacatacacatttaaaatcagttatgtattataaaatactctccagaaaggaattaatgagagtggacctctcatcacaaactaccaatacaggcattatcgggtgttgttttttttgttcttgttgttgttgtttttgtttttgtttttatttgagacaggatcacactctgtagctcaggctggcgtgcagtggcacaatcacggctcactgcagccttaacctcccaggctcaggtgatcctcccacattatcctctcaagtagctgctactatggggactacaggcatggcaggtgccaccacgcccagctaaatttttttgtattttttttgtagagctggggtttcaccatgtcacccaggctgatctcaaactcctgggttcaagcaatatgctcacctcggccttccaaagtgctaggattgcagacccgttgtcagtttttttagtcttagcctatctgataggtgaaaatttctatcttatttgaagatttgtttctttaattattaagatttagtatattttaatgtttgtatttttaaaatgtttatatgccatttgcttttattgttttgtttagtaattttcatttattgcttattctatcctccactggtttttctgttggtacctatattgaatatgtgaactctttatatattaatggtatcccttttcttttactgtcacatatgttacaatttcatcttttctgtcatttgactttttattctgttcatggtgttctttcacaaaagttttgtgtggtcatatatgtcagcccttatgttttttagttttggtgtcttattgttattattgttgatatacaataggatagttaatgcacgttacctcagtatacattattttgctacttggaatctatttctagaaaaatgtagaaagttgattaaatatgccacaaggataaccattctcagcgccatgtaagtttgaatatgcagttactctaacttgttttacttatcctaagtcttacttgtcagttttttatacatcatattaacatttctacatcaatttaatcatctctgttcattattttgttatttatatcacttaagatctgtgttttctctattagatcactgttttatctccacattgtattctcttcaaaatgaagagttatgtctccttgtttagatctatcacggtaccacttacctgataataaccacttttgatgatagctgtggtggtgggacccaaaatagatgcccaggtcctagcaggttacatagttcctacaaactggttgtagatcctaccagcaacagactttttaatcatcctttcaccagacttgaccattatatttaaaagagagaatagtacagtgttactatgaaatggatctactatgcatattctcactgctttaaaaatcactgatgatataaaaagagaagactgcactagcttagtgtttgatcttgaccatatagatctaacgtcatgatcaattgctttcagcattttctttgaaatcacataaggttcatatgtgccaaatttcataaggatcacatgataaggtcaagaaatacaaattccaaggcagaatttatatgcccacttcacatatgacagcaatactaaataaccatatgttgaatataatacactgtatgtaaatactattcttgaaagcaatccaatcaataaaacctaaaataaataatactttaataacacatttcaaatagactgaaaatggaatagatggactctatggcaagaacatccctataaaactgacattcagaggccattaaaacacagagagtaaaacaatcatgaaactaaagaaaaactgtgaatatttagaagttttttaaagcctactacactgtatgccaagatacagcagtcgtttttatttaaagagctatttcaataaaagctgtggattcctaagtattaaaaagcaaattaagtttaccacaaccaatagccaaaaatactttttaaaaaatatacaatattacccagaaaattttaaaaatacatagtattaaacagaaaaaaagtctaaacagaaaaaaagtcaaaacagaaaaagctcattttcattataattaggattattaagagactgaccaattttatcaatttaaagaaggttgcaggaaagctactgaggttaacttcaaagatctagaagtaaaaagtgattgtaatgtcagtaaaactcttaaaacagatcaaatagcccctaagtagtactaatctactgtatctttgaaaatgtatatgcttttttttaaagctgacaagattgtccttttttctttgtttttaatatcacattttaaaaaatatccaaccattaaactgtaaacagcagctcagaatacataaactttaccttccctcatttgtgatatgaattcagatttgaacatttttttcctctttgttctggaaaacatggttttgtcatcccacattgtacagtgatagtttatctttttcagcgcgagtgcttgtttactgtatgtgcacaaacaaatgaaacaatgaagcttgcaaacagttatttaaccagtttttctctcatttattaactcaaactcatatatcaaaatgagatatttgtgatgtaactgatgtttttaatttcaattttgtcactttagatcctgggaagactctgcctgaagcccttgattattgcactgtttggctacagacagtgcctggagaaatagacagcaaaagtggtattccaccttcctttataacactacagattaaagactttctgaatggaccaggtaagaaagtcataaaatttacatgtgtgtacattttttatgtgaatatattagcatgtatataggatctgttagtaatcttgacattccgtgcaaaaaatgaatagttcattttttcccagaggtgtatgcttttcaggctgcccattttagagatcaaaaggcaaatataaatatgcattaagaattaccttcagtctgacaaaaaggtagttatcaattaaagaatagttgactggaagccaaagccccaatattttatttctacctttcctattaattaactgtatgatcttaggtgattgatctaatcttctatacttcagttttcttacctgtatatgaagaggatagactagatggatgaatggataggaaacatgatatatatatacataagatagtatacatagatagattagatttgatagttaaatgtacctgtttcacatgcttagcaaagtgcttgaaacatagtaattactcagttttagatagatacagatatcaaaaatttttgagagctaattatgtcccaggcactatgcattttaggagtatgtactatagttattcttattttatgaataaggaagctaagacttagaaaagtgaagtaaattgcctaaggtcatagtgacagaggagccattcaaacctaagtctttatgactccaaagaccagagcttaacttctgtactacactaatttgggcataactaaagtttttttctttattcctcgatcttcctcctctgtcttttcttccttcatctcatgttcttccccctcttctgttatttctccctcacttccgtatagtcttagctatttatttaacaaaaattattacatttcactttttgttttgttattttgtagttacagtgcttcagagtgttacccatggaatgagtattagtttcttccttaagaattttatttaattttatttatttatttatttattttttgagaccatcttgctctgttacccaagccaaagtacagtcgtgcaatcatagctccctgtagcctcaatctcctgggctccagcaattctcctgcttcagcctcccaagtagctgggactacaggtgtgtgccaccacgcccaactagttttttttatttttagtagagatgaggtctcgctatgttgcccaggctggtcctgaactcctaaactcaagcaatccgcctgcctcagcttcctaacgtgctgggattacaggtgtgaaccactgctcctggccattaagaatttaaaataggctgggcatggtggctcacacctgtaatcccagcattttgggaggctaagataggcagatcacttgagaccaagaattccacaccagcctagccaacatggtgaaaccctgtctctactaaaaataacaataaaaataaaaaattagctggccatggtggcacgtacctgtagttccagctactctggaggctgaggcacaagaattgcttgaactgggaggcaaaggttgcagtgagatgagatcacgccactgcgctccagcttgggcaacagagcaagactctgtctcaaaaaaaaagaaaagaatttaaagcaatgattttacaactgtcttaagatctctagcaataccccgcaaggcatgaattttaaggaaggaaaaatatttatatatagactttgttgagtacatgtgttgtggcgtgctagtgtacttatgatccatactacagatggagaaagccagtcatggattaaacagagactgaaaccatctccactgactttgtcactggggacgaattcttcttcagcatgtttttctagtgctgggattgtaaaggtgtagaagtatgaagaactatttctaatcttgataaactctagatatggttttaaatatatgaaggaaagcaagaaactgaaggataagcaagtcattaaagtgtaggaagaagcctttggagtgaggtaatagactgaagaaggtgagtgctagtatttggttagtaagcatgaagtaccatatttcattccatctaagccactagcaattgtaaaaaaacattctatatgccactaaaaatgaaaaaaacatatgctctttacactgtgatacagggcctttttattacatcagtttgaagacacttcctgatttcagagttgttcacacatgaaagactgaacacaatagaatagatgcaatagggtaagaacacgtaattagttcatggaagagtgacaggggaaacttggatttacttatttctcagttttagtttcacattcgttttgtttttaggcacactttgctcattttggctagaaaattatcttgtagtttacatttgattgatttgtttgtaaaacaatggaatttgaaagttgatggtaaattagatacaatattttcaaggcaaccaaatcaattgaattttaagagaaatgccaatgaataaatgaaaaattatgtatttacaattctggcatttaacatgactcagtattagaaatgtgatttttttttttttttttgagatggagtctcattctatcacccaggctggagtgcagtggtgtgatcttggctcactgcaacctctgtctcccaggttcaagcgattctcctgcctcagcctcctgagtagctgggactacaggcacgcaccatcacacccggctaatttttgtatttttagtagaggttgggtttcaacatactggccaggctggtctctaactcctgaccacatgatccgcccaccttggcctcccaaagtgctgggattacaggcatgagccaccgtgcccagccagaaatgtacttttttttttttttaatcatactttaagttttagggtacatttgcacaacatgcaggtttgttacatatgtatacatgtgccgtgttggtgtgctgcacccattaactcgtcatttaacattagatatatctcctaatgctatccctccccctgacccccaccccacaacagtccccggtgtgtgatgttccccttcctgtgtctatgtgttctcactgttcaattcccacctgtgagtgagaacatgcggtgtttgggtttttctccttgtgatagtttgctgagaatgatgttttccagtttcatccttgtccctacaaaggacatgaactcatccttttttatggctgcatagtattccatggtgtatatgtgccacattttcttaatccagtctatcgttgttggacattcaggttggtttcaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggtttaactagtttacagtcctgccaacagtgtaaaactgttcctatttctccacatcctctccagcacctgttgtttcttgactttttaatgatcaccattctaactggtgtgggatggtatctcattgcggttttgatttgcatttctctgatggccaatgatgatgagcattttttcatgtgttttttggctacataaatgtcttcttttgagaagtgtctgttcatatccttcgcccactgtttgatggggttgtttgtttttttcttataaatttgtttgagttcattgtagattctggatattagccctttgtcagatgagtaggttgcaaaaattttctcccattctgtaggttgcctgttcactctgatggtagtttcttttgttgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggattgagtttcagctttccacatatggctagccagttttcccagcaccatttattaaatagggaatcctttccccattgcttgtttttgtcaggtttttcaaagatcagatagttgtagatatgcagcattatttctgagggctctgttctgttccattggtctatagctctgttttggtaccagtaccatgctgttttggttactatagccttgtagtatagtttgaagtcaggtagcgtgatgcctccagcttcgttcttttggcttaggattgacttggcgatgcgggctcttttttggttccatatgaactttaaagtagttttttccaattctgtgaggaaagtcattggtagcttgatggggatggcattaaatctataaattaccttgggcagtatggccattttcacgatattgattcttcctacccatgagcatggaatgttcttccatttgtttgtatcctcttttatttcattgagcagtggtttgtagttctccttgaagaggtccttcacatccctttaagttggattcctaggtattttattctctttgaagcaattgtgaatgggagttcactcatgatttggctgtctgttattggtgtataagaatgcttgtgatttttgcacattgattttgtatcctgaaactttgctgaagttgcttatcagcttgaggagattcacagccgaattctaccagaggtacaaggaggagctggtaccattccttctgaaactattccaatcagtagaaaaacagggaatcctccgtaactcattttatgaggccagcatcatcctgataccaaagcctggcagagacacaaccaaaagagagaattttacaccaatatccttgatgaacatcgatgcaaaaatcctcaataaaatactggcaaaccgaatccagcagcacatcaaaaagcttatccaccatgatcaagtgggcttcatccctgggatgcaaggttggttcaacatacacaaatcaataaatgttatccagcatataaacagaaccaaagacaaaaaccacatgattatctcaatagatgcagaaaaggcctttgacaaaattcaacaacccttcatgctaaaaactctcaataaattaggtattgatgggtcatatctcaaaataataagagctatctatgataaatccacagccaatatcatactgaatgggcaaaaactggaagcattccctttgaaaacggacacaagacacggatgccccctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccagaaatgtactttttacaggagctgtacttttgtgtttcttaagatacttttcaaagttaggaattaaatatatataatttctgattttatgtccatgctgtaatagtgataatatatttagagatttaaacttttaagtaaatgaattgaaatagttattttacagcagcacttctcaaacttgattttgcatttgaagcttccctggggagtttgttaaaatgcaaatggtgatttaatagttctagaaggtagggcttgaaagtcatgtctaaaaagctcccagatgaagtagatgctgttggtctgggactgtactttttgtagcaagttttatatggctcttatcaaacttctttttaaaaaattatacatgacttatcatatatgatttttgtttttagtatcagtcacagtctttgagagccaaaccacagatattttggggaacaggacagggtaatgataaagaaagatgaatggtttttagaatggtgctttgattatggaaaatcaaatataatatccaatgaatgatttaagttcttcaaagtctaaaacattttaaacaaaagtactttttttatttgagagaagattagtttaaatgatatatcagctgtgtgtgacttcttctaaaacactaacctaacagcctgtaactgttccagaatttactagcttagacaaaaattttcctactgtaagcaatttgtgatttagagtagataagtagatgttatttcatagagtaattatattgtctcactacacagccagattggcatgctactacattaatttaggaatcaaatggctatagaagatagtgagacttgcataccactaattaaatgggaataacaggacacattaaaacagcttttaccatacgaatgtattattttatagattttggcaactcaaggaaattttattttttccagctcttagggaataggatactaagaggaatgtcatttatgttgagattgggcaaacaaatttcagctttataatgttcccaataacattccctttccttgaagaaaaagcattacaaaaaaataataaaagcactacaagtaatactttttgtttttaggtaatgacattgtgttatcattagaaatctttagctattattatgttttaatctgtatgcatacctatttaagtatcattccagagaatgtcttgaactatattagtaatttccacctattttttttcttgttctttaatgaagggtatagtaacaatgaaagttatgaccctgaattaaccaggcatggtgatatgtgcctgtagtccttgctactcagagagccgaggtgggaggattgcttgagcccatgaggtcaaggctgaagtgagctatgatcatgctactgcactccagtttgggcaacagagtaagaccctgtctcaaaaaaaaaaaaaaaaagttgcaacccttaaaggtagagggaatactgattataactgcctaaccttaagctttcttcaaaaagatgtaaacttcacagcttttgaaatttagccttttagatgtattttgcagggattattttctctaaacaaggtgatacaaatgctgctctttagcatttgtttttagaaaaataatgtagagttcttgagtattcccctatttcttctgttcacctaatggtaccttaatagagcaaatggtaggtcccaacttctacatcaaaaactctttcaaagctctcccaaccccccaccttttccccttgtacccattagcaaggtcagtggcttggagaaacctggaaaacagcagctaccagaaacccactagaataatatctccagcaggtgatagattagttggaacaaattggaaccattgcagttcggcaatcctggtttctttcaagctgtttttaaaatgtcgtcattttaatacacaatctaaaccctgcggaacagtccacagcaggttaatttgaatcatatgatgtgtcactgccctcagctgacatgagctctattccatgtgtgaagccataataaatccattcccaaccaaggaaaattccccgtgagaaggtgaactaatccaggcctcacactggcatgctagccctccataattgaaagcagggccacctgttcccagcacagttagcctatagaaaaaaattagcattagatcagatacgtcttatattgaaaaatcaatcatacttcttgcaaattcaaattcatctgtgaagtgtttggtatgacatcatacagaaatgtaggaatgtgcccacttgatcccattttaaaagtttttttaaccataggattccttaactttgaaatgcaatttttttttaatttaatgagagctgacacatgagaagaagaactggaaatggtgcagatttttctaattaactcagggttatttgcaaaaacatttgagctctctggtatttttttcattgttctttcacgaatttttgagccactgtcattgtagccatgaaatgacatttaaatgacaacaaagaacaaaaatgccacattgggaaaacattcccaagtcatttatgttttattataaattaatgcttagcatgtcacattcatcatataatttaaataacatggttatatcaaacacaagacaatgaatgcaatttcacatttcttttagtgtagtatatatggtgtctatatttgaaatgcatggccactggtctttttctcctaatagaatcacttctttagtctcaccctgtttaactcattcattaatttacctgtctagttgtcagtgtttctgatttcattctggcttctgattggtttcatctctggttttatttgattttgattttaagaatctgttgacttgaactggttataatcctgttttgaatacagttttctccttatattgtatggattaatgtaactattttataggttacaatgattttcatttctactttaaaataattcctaaacatccttaaatgattgcatttccacaaacctttctgatttgaatgaatatttgtacttaaatgctataaaatagtaaaagagttcttaggtacagtaacacagcattcaaataggtttgtttatatgaatataaagtagaaattttaagttgtttacccccaaatagatgtattttttgagtgcttttgcctttcttggttaaccctgcttttatgttattactgaatttattactcagtggggattaactcagacatatctgaaggtaactgattcaggaggattgagatacctggaaaagattaatcaaatagtgtctcgatttttctggagtagaaaatgaggaataaataatgtgattttttaatctttaaaatttttttcaattgcaaatttcaaatggatttttggttacctatttcaagctttattgaggtataattgacaaaaattacaaacatttaaggtgtacagtgtggtgttttgataaatgtgtcattgagaaatggttaccatattcaagctaattaatatatttatcacctcacatagttacaactttttatttgtggtgagaacccataagatctcctcttttaccaagttgtaagtatataatacagtagtatttattaattttagtcataatgctgtagattagatctccagagcttatacatcctgcaaaactgaaactttgtacccattcaccaacctctccatattgtcccttcccctagcccctggcaacaaacattctaatgtctccttttataagtttgacatttttacgttccatatataagtgaaatcatgcagtttttgtctatttctgtttggtttatttcatttagcataatatcttcaagttcatccatgttgtctcaaacggcaggatttcaatctttttaaggagtgaatgctattctattgtaaatatctaccacattttcatcctctgttcatccactgatgaatacttaggttgattctacatcttgactattatgaattgtgctgcagtaaacataggagtgcaaatatatctcttcggcacactggtttcatttcctttggatctatacccattagtgggattactggatcatatggtagttatatttttaattgattgaggaatctccatattgttttccataatggctgtaccaatctatattcccaccaacaatgtgcaaggatttccttttctccacatccttgccaacacttgttatgttttgtctttttgataatagccattctagcaggaatgatgtggtctttcatgattttgatttgtatttctctgatggttagttatattgagccctttttcatatacctgttggccatttgtatgtcctcttttgagaaatgtctatttaggtctttttcctatttttaaaatttggttctttgtcttcttgctattgtgttgtttgaatttctcatatattttagacattaacctcttatatagtttacagatattttctcccattctgtaggttatctcttcatactattggttgttttctttgctaggcagaagcttcttagcttgttgtaatcctatttttgcttttgttgctggtgcttttcagataatatccagaaaatcaccgtccagaccaatatcatagagcttttcccctgtgttttcttctagtagtttcgtagtttttggtcttactacatttaagtcttcaatctattttgaagcttttgggtttgtttgtttgtgttttttgatttttgagtgacggagtctcactctgttacctaggctggagtgcggtggtgtgatcatggctcactgcatcctctaactcctagtgtcaagggatcctcctgcctcagccccccaagtttagttgacttttgtacatagtgagagataaggatctactttcattcttctgcatgggctagctagctttcccaacagcatttattgaagagaccatcctttccccattttgtgttcttgacacctttgttgagaactaattagctaatacatggatttctttctgggttctctattctgttccattggtttgtgtgcctatttttatgccagtactatactgttttggttatagttttatagtatattttttgaagtcagacagtgtgatgcttctagctttgttccttttgctcaagattgctttggttattcagggtcttttatggttccacataaatttcaggattgctttttctatttctgtgaagaatgtttttgatactttgatagcagtttcattgaatctgtagatcaatagcatgggcacatcaatagcatgagtaggatggacattttaataatattaattcttccagttcatgaacacaggatatctttccattgatcaccgttttatagttttcagtgtacagatttttcacatccttggttaaatgtattcctaagtatttaataatttttttagctattatgaaatgagattgttttcttagtttcttcttcagatagctctctgttagtgtatagaaatgctataggtttttgtatgctgatttttaatcacgcaaattcactgaattctaacagtttttagaatgtattaattctaacagttttctggtcaagtttttaaggttttctatatataagaaaaccttaaatgttataaggttatctgtggagacaatttaaattcaccttttcctatttggattccttttatttctttctcttacctaattgctttgtctaggatttccaatactatgtggaataagagtggtgagaatggccattcttgtagggttctagattttagagaaaaagctttcaacttttccctgttcaatatgatgtgacctgtgaatttgtcacatatggcctttattgtgttgtggtatgttccttctatacctaattttttgagagttcttatcacgaagggattttgaattttgtcaaatgctttttctgcacctgttgaaatgatcatatggtttttgtcctacattctgttaatgtgatgtatcacatttattgatctgcatatgttgatcatacctgtgatgacacccgcttgatcacgagtagatttttaatgtattttaaattccgtctactactattttgttgagggtttttacatctatgttcatcctggatattggcctgaagttttctttttttagcatgtctttgtctggttttcatatcaggctaatactggcttatagaataaatttggaaatatttccctctcttcagttttttggaagagtttgagaagaattggtggtattagatatttaagtactgagtagaattcagtggtgaagtcattggaccctgggcatttttttgatgggagattttttattactgattctatctccatactcattattggtttgttcaggttttctgtttcttcattatctattcttggtacattgtatgtgtcccggaatttatccattaggttattcaatttgttggcatataattgttcatgttattccctaaggattctttgtatcagttgtaatgtctccttttccatctctgattttatttatttgagtcttctcttttttgttcttagtctagctaaaggtttgcctgttttttcaaaagactggttctttgtttctctgatcttttctattatttttgtagtctctatttcatttatttctgctctgatctttattttatttccctccttctactaatttggggctttgtttgttcttgtttttctagttccttgtgttgtaatgtgagattgtttattttagctctttcttcatttatactgtaggtatttactgctggaaaattcccctcttagaactgcttttgctatatcctttaggtttaggtatatggaaacaccatttcatttgtctcaagaaatttttaaatttttcttttaatttcttcattgattcattgatcattcaggagcatgttatttaatttccataaacttgtgaattttctgaaattcttcctgttattggttgctagttttataccattgttttcagaaaagatacttactatgattgcagtcttcttaaatttgttaagacttgtgatctgtcttggaggatgttccatgtgcaattaagcagaatgtgaattctgcagcttttggatggaacattctgtatatgtttgtcaggttcaaatgttctagattgcagtttaagtctgatgtttcctgtttaattttctgtctggatggtctacccattgctgaaagtaaagtgttaaagtcctccactattattaaattgcagtctatctctccctttagatctagtaatatttgctttatatatttagatgctgcagtgttaggtacctatatactacaatgttatgccgtcttgctgaactaatgcctttgtcattatataggacttgcattatctctttttacagttttcacttaaagtatgatataagtatagctacttttactatttttgggtttccatttgcatggaatatcttttttcattccttcacttttaacctatgtgtgttcttataagtgaattgagtctcttgtaagcagcatatagttgggtgtgtttttataatctattaatttgctctttcttttcattggtgaacgtaagccatttacattcaaggtagttattgaaaggtaaggactaagtactgccattttgtcaattgtcttctggttgtcttatggactctttgtttcttcctctcgctgtctttctttgtggttaagtaagttttctctattggtatattttgatttcttgctttttaattttttgtgtatctgcatggttatcatgaggcatatcaaaaaatcttatagttataacaggttattttaagctaataacaatttatctttgatcatgtacacaaaaaacctctactcttatactccactacctccctccacattttgaatgttatttaaaaatttacatatttgtatattgtatattccttaacaaattagtgtcattaatatttttatctttgaacctttacactaaagatataatttacacaccaccattacaatattagaatagtctgcatttgatggtatatttttaccagtgagttttatactttcagatgttgttgcgttattatcatccttttctttcagcttgaaaaaaactccttagcatttattgtaatgcaggtctggtggtgattaactccctcagcttttgtttgtccaggaaagtttttatctctctttcattaaagggcagctttgctagatacagtattcttggtttgcaggttagttaattagtttgttttccagctctttgaatatatcatcccactctcctctggcctgtaagatttattctctgttgagaagtgtgctgctcagtgtattagaatatccttctatattctttgcttctttcttcttgctgctttcaggatcctgtctttgtctttgatctttgatagtttgattgtaatatgtctttgggtaatcttatttggattgaatctgattgaagacctttgagcttcttgtacctgaatatttatatatttctccaggtttggaaagggttctgctgttctttatttacatatgctttctacccctttatctatctctattctctcttgaataccagtgaccaagaatttacccttttgatgctgtcccatgaatcctgtaagctttcttcgttcctttactgtgtattttttgcctgtatattttcaaataatctgcctttgagttcatagattgtttcttctgcttgatcaattctgctgttgatattctcttttttatctttcatttagctcattgtatttttcagctgtgggatttctgggggtttttcaaattattctttcaatctcttaaatttctcattctggtcatttattgtttttcttatgttgttgaattgtttatctgttttcctgaggcttattgagtttccttaaagcaattattttgaattacttgtcaagcagttcatatatctctatttttcaggggtcggtcactagcactctattttgtttggtgatgtcatgtttctagttttgtttttttttattcttgtggtcatgcatcaatgtctggatattgaagaagtaggttcttattccagtctttgcagtctggctttgtctgagaatgcccttcaacagtaagcctgtctagaactttttggtcatgttgtctggcattgtccctaagtccatgattgccacagccatcaaagctctagagggcaccctacacccaggcctgccacaccagcccaacaccaggatggaatcccgtggccaccaaggttggcacagtgctggggcatactcaaagcccatggccattcaggtttgtctgaaaccaaaggccttgtagacagctggtagtgattcaggccagtgatcaagtctatttcataggggctatgggatcctgcctagcactgggacaggtcaagaggctcagtacatgggtactgacctaaataaggggctacaagagtctgcctgatgctagattttactatggcaggcccagtggtggagaccaagacaaagtcttacattcacttccttctagttcccccaagcagacggtgtctctctgaatttgctacttggggataggggagagttgacacagagaatgtccttcctactctcttaagtacatcttttcatattattatgatataacaaggtactgtgatcgctcacctcatttctttagctcttgtgaaggtattttcttgtgtgaatagttgttcaacatgatgttgctatgaggggatgatcgctgaagagtcctattccaccatcttgctccaccctcataatatgatttttaaatgcaagaagattcaaagcaaaataaaatattttaagaagctaattttgggctgggtgcagaggctcacacctgtaatcccagcactttgggaggctgccgtgggtggatcacctgaggtcaggagttcaagaccagcctggccaacatggcaaaaccccatctctactaaaatggacgtgatggtgcatgcctgtaataccagctacttgggaggctaaggcagaagaatcgcttgaacccaggaggcagaaggtgcaatgagccgagatcgtgtcattgcacttcagcctgggcaacaagaacgaaactccatctcaaaaaagaaaaaaagaagcagctaattttaataatttatttctgttcatcttacccaaaatatcatttttaaatcatatttaatcctctgccccttctctcttgccagaaattgggctaaggcctataccttaatcatgagagtcctgcctctatcttaattcaattttacagccatgctagcaggctatcttctacatttaagaaatgtaaactagttaatgaaactgtaaggaccttgacttttacatttcctgaattttatgggttccaatttccagtgtcagtgctatattatcatagtttgttttctctgtgatttatcaaaatgaaacagtaaacttgatgtcagaatgtcaactacggaatggaccaagaattttaaaatagggaaaagccttccattatttcaacttttgtttttcaactataacttttattttaggaagaaatgagaaaaattacctagctgaaaatggtgccctcaagggtttacacctctgaactacttggctaagtaatagacctcaaagagtcatagaggctggttgtgcagttggcagggaggtagggggccagtactaggtctcatgcagagaagtcagtagagtcgcagtcatttagatttttttttatttcttcatctagcctaattctgttagaattatttcttctacagaaaagagtgagagtaattgggaaatgtcttcctaggaacatggagtaagccaagttagaagagataaagaacattttctggcttatcctaactctaactttccaactttctgcctgcagtttttttccttactctccagccccatgcctttccattgacacagtcttgagccttcctttcttatccctgtacaatagtctcttttatgccaacaactcccaaatgcagctcttttgacttaatatctaactctaagactatttctacatataggtattaggtatactttgttatttaaacatgttcacagtaaattaagccattttctctcttctctctccttgctcacttcttcctttatcatagtcttcaaacttttttttacaactgctgatgataggaaaaattttctggtcatgtcctctcacaatttactaccatcttcaggccattcttatttttatttcaagtccttctacttttttctttgaaatagtcctcaattatgcctgctacttctctggtgtaggcttaatccttgattacttcctcattctgtttactggtagcactaacttcagattctcttatttactcaataatgctgtcttctatgcccttactagatttgcctcccctgccaaatttatttgaatcttaactacccccttcctcagttgatccagtcaaaactctcctcagcccccaaccctttgtgcacctgttcactgtatttcttacatataaattgcttatttggcttaatctgattctgttttttttttttaagaaaaactgttttgcaagaggttttgtattgctctatcaggaggcatataatgtccaaaggtctctctttttgtgatgctagcacccattggtgctcaatgcctacatttattggaggttgtaaatagtaatattctaattctagcattccttttccatatgttagctggcatacttctttgaagagaagcattccccaacctactatttgagtattcagtagtattgctcattcaaaaaagcaggataaatgcttaattctttccctttatttaccccttttcaaaaatgagttcattctctagcatattccaatggtggccagttagttgatgttgtttgatattattttgaactcattatttttaataattctcaagttgtctcaccattggcagtgagaatctctataaactggcttctctatgttttaaaccttgctgttttcttagtctgcaattcttacaccctttttctttgcccactctaattctcagctgccattaggttagcctaagtcttgttttcttctggaatagtttccctttcatttccattcatgctgatctctcctttttcataagcagattagtaataccattttcactaaatttatctcaaaaccacttttggctgtttctaaaaatcatgtgtgtcatcaaggatgagtatatgccatcattgaaatagtaaaacaaacaaaggatgacataggcaccaaaaaagatacaaaattgttggagtagtggaatatagttatcccttatggttattactaagagggagggaaacttattttgatgagtttagttcagtacatttactttagaaattggtgcaattaccctataattagaacttttgtgttgtgatttggggaggattatgaaatttagaaagtcaatgtttgatcataaaaatacgtttctgagtaattttgctagtagtgatgatgtccagatcccagtgataagtatcatgaactgctgctgacttattcaggtcaagaacctttcatttcatgtctctgagcttcctcatagcacataagacagcatgtagcctgttccactttgtataccatcattaattaaagcacacgtctgccatcactgaggtctttacacttcacaccttcaatgaaagcacattaatctcattgtcatggacagctttccaggttttctagctcttatacctgtgaatactccgtctcccttgtccactgtcatcatgaatacctttacttgaacactataacaaaaacctgaatttcaattgctgaataagagaaaaaaatattatgacctagtaataattttttaccagagttattataatacataaggtcaaccttgattatgggtttgttagttctgtgttttgcatttactaagatggtgaataaaaacatcatttctgtgtctgtacatagccacccgtgtatgcactgaatgttttcttgtaagtcttgcttgtctaaaaaattttttatcttttgcaaataaaattccacaggaagaaacacttaacaaagaagttttctttcataaatgttatgatttgagtataacaagccatattgaattcattgggtttttggtaatagatttcataatacatcataaatgtaagtaatatgatgactaatgggtcaagtaaagttggaacattttaaatgagaaaagagctggaacagttctcaggaaacttttccagttgatgtttggtcccccacaaggtgtgcattaacataaacttatgggaatcacctctggggcttgaattccctctctgatttcattattacaatgtgatacttttcctttcactattaagtcatcctctaagatgataggagcataaaataagtataatttatttgcatttgtctaatcttttaactcaatagtcattccatcattctgtttcctggtagctgttcagaaagttttgaatggtaattaggatctaataattggcaggcatgggtttacttaaagatacagaatatgttctgaaaatggtgagaaattagatctggcagagacatagatgactcagctgggagattctctattactgcatattcctaaaatcaaaactttgaaaataatccatttattaaagttcaatgaggattataacacaattctaaactcttaaacataagtatctgataataattggaataaaatttatagtaacagtctgtgcctggttccctatccagttatatttccagttcctgtaaaacattattctttatagctccccctgtgtctctgttgaataaaactgtcctagtccatttctttaatgttgtatcttaatgatcagattaatatttttatcaattttttaaaagtatcaaaaaacaaaatgtggcttgctcaatttttacttttattttttaagttaaaaaataccagacactatttttgcatatttttttctatttgtaaaaataatcttcctgtcattatcagactgaaaatatttgcaatgaagactaattttctaccaaaaaactggctagatcaaggatgtgaaagttcagagaaacatgttgatgtactttatacaacaataaacagtgctgtttcacttgtgatggttctcattctggtgcgtgcctcctgtcttttggtggacctggtacttttgaaaggaatacctggtattacaatatagcctaatttcaactgcttttttggttcttggcctatcatcttttccaacttgcccaactgggactgccctagccactctgttcacacattgcacagaatatgttttgcaagaaatgtggctcagcactgtctctatgtggtccagtccctccagggtgagggactttgtggcctactaacgtacgtcttgtacagaggttgcactgtatgccctgtatggaaacaaatatacaaaaaacatttgaaaagtgaattacttaaatgtcttaaatagcaatttgtttcttattaaaccttaacagaatcatgtgagtctaggagtttgagtctgcagtgagctaggatagtgccaccacactccagcctaggcaacagaccaagaccctgtcttgaaaaataaataaataagttaacatagcaactgtttgggaatacatatagctctgctagattttcaaacgttctaaaaactttcatcaactgctgctcagtgactgagaggttgcatttgtaatccttaattactaaatttaaggtaatcaaaagaattaaattttgatacataaataacacttttgacataaccttataggaaagatagatcaagtgaccaagtgtccaaataagtaactcccttaccaatccactggtctgagaaagggtcgtccagaaaccagcaccacaaaaagttaacattaaaaattcactgttcaaattcacaaaacaaaataaatctataaaagatttaaataattaaacttttcaaatgatgttttttaaatcagcctgcagcatttttatgctgctgaagttattaaagtttaaaatcacactgagacttttgggacaaactatgagagacagagatccaagattgcttcagatttttcctaaaatatttagtgctgtccaagcatggtggctcacactttaatcccagcaatttgggaggccaagacgggtggattgcttgagaccaggagtttgagaccaacctaaccaacatggcaaaaccccattctactaaagatacaaaaaaattagccaggcatggtggtgcatgcatgtaatcccagcttctgagatttaaaaattaggctatctaaaaattagattattttctcattgctgagttataatacttttttatatttttttgatacaagtcttttgtcagataagtaatttgcagatattttctcccagtacatagcttctcttttcattctcttaacactaccctttacagaggaaaagtttttaatctgatgaagaccaacttataaatttttaaaatatgcctttttggtatcatgtataagagactcagtacagagtttctctgtactgagctgcctggagatggggctagggaaggtaacatcagcattgtggtggccactgtgctgagtcatacctgaagccagcacagcactgggcctcacccaaggcccgtgataacccctgcctggctatccgcctgtgttcactcaaggtcctagggctctataacctgccaggcttgtgtccctccctataggacactgaaatttctccagtcccaggtacgtccagagatgctgtccaggagccagggcctggagtcagaaaccttaggaatctacttggtgctccattctactgagaatgagctgacacccaagccacaactctaggacttgaagattttctcctatgttttcttctttgaagaccttctaattttacattttatatttaaatccaggattcattttgagttaatttttatatacagtatgaagttgagtttaaggtacttttttttgtatacagatattcaacaccatctgtaaactacctttctccattgaactgtctttgcacctattttaaaaatcaactaataattctttggaccctatttctggactctgttctgttccactgaggtacatataccctctccaaaactatactgtcttgatcttaatagctgatagtaagtcttaaaatcaggtagtttgagtcctccaatgttgttattctttctcaaaaatgttttggttattcttgttcctttgctttactatgtaaattttagaatcagcttttctatatttaaaataaatatttctgggattattggaattctgtgaaatctacagatctgggagaaactgatatatttactatgttgtctgccttcgaattcatgaatatggtatgtgtatggtatgtctctctatttatgttggtcttttaaaatttattgtcagcattttgtagttttcagcatacagatcctatgaccatttgattagatttatacctgtgttccttttatttggatatgttataaatactatcttttattttaaggcttttttgttttccacctgcatattgttagtttatagaaactcaattgatttttgtgtgatgatcttgtattctaaaactttgccaaactcacttattaattctgggagcttttccgtagattcttattgggttttcaacatggacaattacgtcatctgcaaatgggcatcgttttctttgttatttatgcccttttatcttgccttgttgcactgtctatgatttccaatactatgttgagtatgaataataagaagggacatccttgccttgtttctgttcttagggggaaagcattcatttcttcataattatgatgttagctgtaggcttttcatatatagccttcatcaggttaagtttccctctaccaatagtttgcctagagttattataaatggatattgaatttttcaaaaatgttttctgcatcaattgatagtatctttgttattgttgtaaactgttaatatttttacattgattgatcaaggcttatagtcctaggacaacccctgttttagttgtggtacatcattagttctgtatgctgatggatttgatttgctacattttttgaggatttttatgtctcttcttgaggaatatccatgtatattgttttttatactttctccatctacttttagtatcggtaatgatggtctcataaaatgaattaagaagtattctctcctcttctatttcctggaggacaggggaatgaagaaaagaaagaaggaaaacaatagatttccctagtccctctgagcattaagagactccttcacactccttgaagccagaaatagagggcttctccttgaactctctctatctccacatgatatccacttctgggctttgggctgccattagtctaggataagggggtaggggaggaaaaattagaaactcatcaccattttggtagtattttgaattctagtcttcttccttagtctacctgttaccatatacttttcaaaattctcaaatagctgctctgtgtaggttttatagctggtttattgccagattttgtaactgcattcagtggaagagacaggttccatcattcctagaactctgaaataatttttaaaaagaaagagtaggcaactgacatcattagatgtttatttggtttttgggttttttgtttgtttgttttttgttttgagacagagtcttgctctgtcgcccaggctggagtgcagtggcacgatcttggcttactgcaaccttcacctcccaggttcaagcaattctctgcctcagcctcccaagtagctgggattacaggcacctgccaccaacctggctaattttttgtatttttagtagagatggggtttccccatcttggccaggctggtcttgaactcctgactttgtgatccacccgccttggcctaccaaagggctgggattacaggtatgagccaccgcgcctggccccattagatgtttttaagatatattagatatttttcctttcaggaaagagataaacaaaacttcaataaatatacctaggtcttgaaacttcattttaattgcttttgaaactggaaatgccatgtgggcaatatgcatatggaatttgtattagttttctattgatgcataacaaattacgacaaatgtagcaacacaaatttatcatctcacaattctatggttagaagtctaggtgagttcagctggttctctgttcagggtctcacaaagccaaaatcagactgttagttggcctgggttctaatctgggggctcctggaaagaatctactttcaaacttattccagttattcacataatctagttccttgtggctttaatattgaggtctccagttccttattagctgttgtccaagggttgccttaagccctagggaccacccattcattctcattgtctcctctgattgtgtattttcaaactcactaattctttcttcagcttgatcaattctgctgttaagagactctgatgcattcttcagtatatcagttgcatttttcaactccagaatttttgcttattttaaattatttcaatctctttgttacatttatctgacaggattctgaattccttctctgcattgttttgaattttgctgaatttcctcaaaagaactattttgaattctctgtctgaaagaaaggtcacatatctctatctctccaggattagtctctggtaccttagtttgtttggtgaggtcatgtttgcctggatggttttcatgcttgtggatgttcatcagtgtctgggcattggatagttaggtgtttattatagtcttcatggtctgggcttgtttgtacctgtctttcttaggaaggctttccaggtatacgaagagacttgggtgttgtgatctaagtttttggtcactgcagccatatctgcattagggggcacccaaagcccagtaactgtgtggctcttgcagactcacagtggtgccaccttgatggtcttggataagatccagaagaattctttggattaccaggcagagactcttgttttcttcctttgctttctcccaaacaaatagagtctctctgtactgagctgcctggagctggggctaaggaaggtaacacaagcaccgtggccaccacaatgctggtggccactgtgctgagtcatacccgaagccaacacagcactgggcctcacccaaggctcatgataacccctgcctggctatccgcctgtgttcactcaaggtcctagggctctataacctgccaggcttgtgtccttccctacagggcagtgaaatttctcttgtcccaggtacatccagagatgctgtccaggagccagggcctggagtcagaaaccttaggaatctacttggtgctccattctactgagaatgagctggcacccaagccacacacaagaaaaagtccttcccactcctccctccactttccacaagcagtggagtctctccccatggccaccaccatcccaggcctgcagcgagtgctacgtggctaccacagatgttcccacaaggtccaagggctcttcagtcaacttgtggtgaatgctgccaggcctgagactctcctcaaggcaatgagctcccctctggcccagggcagcccagaaatgaaatgccatccaagaaccaaggcctggaattgggaatcccaagaacccacttggtgctctttcccactgtgggctagctggtacctaagctgcaagacaaactacccttcacttttctatctccttttctcaagcaggaatccctccctatagccatcacagctgggaatgtgctgggtcacagctcaaaccagcatatctttgagtgtctcacccagggcccatggtgagtattgcctgggtgctactgctaattatttaaggcctaatggctcttcagtcagcaggtgatgaatcctgcaaggactgggtccttctcatcaaggcacggttcccttctggcccaaggtgtgtctacaaatgtcatttgggagctagggactagaatggaggcctcaggactctgcctggtgccttatcctgctgtggctgagctggtatccaagctgcaagacaaagtcccctttactctccctctcctctcccagagctgcgagctgtgctgcctggattggaggaggggtggcacaagcactcccttagctgccccatctggtgtctgactggattgcatgccccccaagttcactggctcctagcccagcacagaaccaggacttaacccagaattgcagttcttgtggcctagactgcctttcaggtttatttaggaccccagagcactttagcctgcagtggcaaggcttgccagaactcaggttctgcccacaggatggttctcctgtggctagggatggtctaaatactccctctgtgggtaccagctgagctctgcctggtattgatttccactgtaacagggcagcatgagttccaatgccaagtcccacaatcactactctctcccgcccacaaatgcacagattctctctctgtgccacacagccacccttgcggagatggaatagggttggcatccacagttcaagactgtctttcctaccgtcttcagtacctctttcagtgatacaaagttaaaaacaggtacggtgattgcttacctgacttttggttcttgttaagttccttttttttttatggataattgttcattttggtgttgctgtgagcagggtgattggtggaggcttctatccagctgtcttgctctgcctccctcttggcctagccttgtgaatgaacttcttggagaaaatgctgaagcagtatcccaatgattaaactggcaaagaaagggtacattagataaagggaacaatatgaacaaggcctagtgatataacagcatgggttgggggaagtgggctctgcaaactcagatattataaggaaaggcaagaactctttcttgcttccttgcttgcttttttttttttttttttttatctgaggagcttgttcttttgtttcttaggtaaggaggaggcaataaagagttttaaacaggagtgagccactcagaattgcatttaaaacaaattatttggaaatcactctgtggagactagattaaatctaaagacaattggtctagacaggggaaccatttaggaggctttataataactgaacgatatcaaaaacatggtggaggaaaatagggactggatggaatgctggagagaaggggattggaatcaagcaatgttttggaactaaaattgacagaacttaatcagtttttggcttgggaccagataaagagggaatgaaatgaggagtcaaaaagtcagatttctgactaaagccacttggtggattatagaaccattaactaagacagggaatacagcatgtctgagaggagttaatggattgcttggataaattaatttgacgagcctgtgagagttcaggagaaaatggcgacagacttgcattcactcatattttcttcattacatcattaaacattgtggggccataggcttttggccccctaaaggttatctgaaaatcactgacatgtggcagattgattaatagaaaagccatacaaatgtatgtaatgtatatacatgggagccttcagcgtgaacatccagcatcccaacaaggtacagaagcttatatatcatctcgaggtcacagaaagaatgaggcttggatcctggtaaaacaggttatgggaagggatagaacagaaattctattgaggggcaataaatgattactagggagaatgactggatcagagagcagagaataacttgtaaatagttatctttgtaacttaaatgaccttgggatagtcactatcttgaaaaagggactgttcaggtgtggttacatttttggtcttctttccggtaaagaataatgagataataaagaggggaacaagaacaattgttctccttggtggggcggtttcatctttatatagatagcagaaatgtctcttctagtacttgttaatctctaagagtttttaatttaaaatactcatcacaactgggaaccatattttgaaatgaaatatttttacctccttcagcattcagttagtacttcctgtagatcaaacagtagtttaggtatttagaatattaaaatataggacagtccaggagctcacagctcactgaactatgacagatacctaagtaggtaactacaaaaataatatcagtaggtgcctggtaatggcaaaatgcacaggatattccaaaagtaatgatgagaggcacctcactcatcaacaagggtcaagaagggtgtgctggccaaagtgatccaaagtctgagtctcaaaaaaaaagttagcgcttggcacagtggtgcacacctgtagtcccagctacttaggaggctgaggcgggaggatcacttgagcctgggagtttgaggccaacctgggcaacataatgggatccaatctattgaaaaaagagaaagacaagttaagcaagcagccagagttataaatagtttttttctgtgtccctgggaccacaatggtgcctgagatatgagggtagcaatcagcagctttagtatttacctctctatggatgctttgccagtctgcagtcagggaaaatggatcccttaggttcagcagttggtttatgtggatatttgggcaacctcctgggtaggttactaaattgtttctacagaatgagtacttctgacccttctttagttttcattttatacacccaagaaaaagacagtttcaggatcgaacatctgagtcttctttctactttagctttgttttgtttttgttctaatgatcatctgttaaaattgcaccttttttttattgttgttaaaggtattattttctgtgaggtcatagaatttggaagcccacatacagggatgcagaggcaaatgtgtgagtcattttagccatccaatttatctaaaatatttttcccaccagcctcttccagtaccccaaattctacaagtcaaaaataaaaataatgcctttcaacaaatgttgctgacataactagatatccacacataaaagaatgaagttgaacccctacctcatacagtatacacacagcactaattcaggaaagatcgtagacttacatttaagagataaaactgtaaaactcttaaaagaagacataggtgtaaatctttgtgactttgggttaaacaatggtttcttggtatgacaccaaaagcacaagcaaaataacaaacatattggactttgcaaaaattaaactgttttgtgctgcaaaaaagtgaagataatccacagaatgggagaaaatatttgcaaatcatatatctgatacaatatttgcaaagtatatatctgatatgatatatctgatatttgcaaatcatgtatctatatatatcaaatataataatcttatattttatatccaaaatataaaaagaactcctacaattcaataataaaaggacaaataaccaaatttaaaaatgagcaaagggtttgaatagatatttctccaagaatatatacagtcaataagcacatgaaaaaatgctgaacatcattagtaattagggaaatacaaatcaaaatcacaatgggatagtccttcacgctcactaggataactgcagtcaaatatgtcttagcagttccactgctacgtacatatttcagaaaattaaaaagcaaatttgcacacacatattcatagcagcattattcatcatcaccaaaaactggaaacaacccaaatgtttattaactgataatggataagcagaatgtgatatatgcttatgttgtaatactgttcagccacaaaatggaatgaagtattgatacatgtttcaacatggatgaaccttggaagcattatgctatatgaaggaaaccgggtacaaaaatcacatattatatgattccatttctatgaaatgtcctgaataggcaaatctatagagacagaaagaaaattagtggtttcttggggctggaggggagcatgagtgaggagtgactgctcagtagtatgggatactgtgtgtgtgtgtgtgtgtgtgtgtgttgattatgatgttctgggattagacagtggtgatggttgcacaaacttgtgtatactaaaaacaataaattgtatgctattgaaaggtaatttttgtggcatgtgagttatatgtcaataaggtgttttaaaaaataattcctttacattaaggtgtttttcctgtttaaaaacatggggagaaaggaacattttagtattgtgcacgggtgactcaagtttctgaccctttccaatgcacaactagctgtaaacaagactcagagttttgttaggcctgataagaaaatacagtgtcagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacagaatggtaaagggatcaattcaacaagaggagctaactaccctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcggacctaatagacatctacagaactctccaccccaaatcaacagaatatacatttttttcagcaccacaccacacctattccaaaattgaccacatagttggaagtaaaactctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccagtgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagaaacaaaaaaacccttcaaaaaatcaatgaatccaggagctggttttttgaaaggatcaacaaaattgatagaccgctagcaagacttataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggatacattccttgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaacagggaatcctccctatctcattttatgaggccaacatcattctgataccaaagccgggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcatcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcaattaggaaaagaggaagtcaaattgtccctgtttgcagacgacatgattgtttatctagaaaaccccatcgtctcagccccaaatctccttaagctgataagcaacttcagcaaagtctcaggatacaaaatgaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaaccaccatcagagtgaacaggcaacctacaacatgggagaaaattttcaccacctactcatctgacaaagggctaatatccagaatctacaatgaattcaaacaaatttacaagaaaaaaacaaacaaccccatcaaaaagtgggcaaaggacatgaacagacacttctcaaaagaagacacttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctaaaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaactggaaaacatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaactccataccaagaaaaaaaaaaaaagaaaatacagtgtccccacatgaaggaaggaacacttacaagggatgggaccctgagagagcctgggtatccaggagcgaagccaaagatcctgatgtctgaggaaggtgagaaggggccctgctcatgaagatgtagaatattaagtatgagtgaatgctgtaatcaatcatgaagccttgatgagaacttctgggtagtccacccagaagtccaactgctgcttgtctcacctgtgccaacatcctggggttgaggagtggagcaaatgttccatttggctgttgcactccggtccaccccgtgtacccttccttcagaggcgatcgccatggctgttaggccttgaggcagaagtgcccacgcacggtggcgagagtgccatggacctctgccacagtggattttatggttgcgggacctcggtgccttcctgtgcacagctggcactcttcacgccgtgtctctgatgacttggtagtagagaagtccctcaagtccttcaaggacaagaacaagaagcttgaggaaggcggccaagtgtacacccccaccccacagaggtggtggtgaataagtcgctcgggcagagggagctggatgagctgaagcgctactgccttggcttctgcctgctgtggatccatgccaagatcgtggtgctcatgctgtggcacatccttgacagccacaccctgaccaggcaaagcgcaggcagtttctccggatccgcgccgacctcctccgcttggtgccgttccttgtgttcgtggttgtccagttcatggaattcctgccgcccgtgaccatgaagctcttccccagcatgccagcatccacgtttgagacccagtccatcaaggaggagagcctgaaggagcttcgggtcaacctggagctggcagagttcctccaggacaccatcgaggagaggaccttgaagaacatagcagccaagggcagtgccaccagacttctccgttttcccagaagatccgggggatgggggagagacccagcaatgaggaaatcatgcgtttttccaaattatttgagaatgagctgaccctggacaacctgtcacggccgcagctggtggcgccgtgcaagctgctggagctgcagtccatcggcatcaacaacttctgcggttccagctcaccatgtgactgcgctccataaaggccaatgataagctgattgctgaggaggggtggacaacctgaacgtcaaggggctgcagccggcgtgtgggaagtgaggtatgtgggccctccgcctcagctgaagcagtgtctggacctgcacctgcatcaggagattcccatatcgctactcatcctgtcccagacgatgtacctcccagaaactcttgccagctgaccagctcaagtccatactgcagactctcccagagattgtggcaaaggaagagcaggtgaaagtggctgaggtggagggtgggcaagtgcacaaggtaaagctggaggtcacgctgcaggaggaggcagccatccagcaggagcaccacaaggagctgcagaagcgctcggagttggagaaggatgtcgcgcccgaaggtgtggaagccacccctcgaaggccaggggcctaacctcagccagaagtgcctgaagcagtcctgtggtcagagaccctgaaggacactgccccctgctagagagcttgaaggagaaggagataactaaggaggaaatcgacatcctcagcgatgcctgctctaagctgaaggagcagaagtcgctcaccaaagagaaggaggagctggagctgctgaaggaggacgtgcaggactacagcgagaacatgcaagagatcaagaaggaactctcaaagactggtaggtgaagaaaaatatgtgaaagcatctaaagccaccaagagactgacagagggtgcagcagatgatcgggcagatcgagggcttgatctcacacctggagatggaccagggcctgcaagctgggcctggcctagggcgcgcccgtaggggagaacatcatcagtgtcactgagctcatcagcaccatgaagcaagtcaggcacattccagaaagcaagctcaccagcctggcctcagcactggatgaagacaagaatggcaaggtcaacatcaatgacctcatcaatgtgattgagttggtggacaaagatgttcatgcctccaccagccaggtggccaagattgtagcgaccttggagaaagaagagaagatggaggagaagactgagaaggaggccgcagaggtgaagagctagagctgctggcctagccacctgtcctcctgctgccccactgccctggcgagggccgtgagagcaattgctttgaggtgattctcagtggctcatctaatacattggctggaatgaatcagagacttccataatcaagtaaattttaattttcatcattccatggatattcacttagtctggaatcccagaacccctccacagaattgtgttggaaccacactgtggtgtggtgcagctgctgcagctgcctgactccagaggccactgggccaggctagggcaggaaggtgcccccttgtgtgtgtcctcccatctcggctgccctgcccccagggaagagaatgaggaccacgcggactctgcccacacagagctgtcagctgcgcccaccctcagaggttcatgagacacagcccagcctcctcggggctgaagatgcctctgttcatctgtgaatcttgatttctagatattggtgtcaatagatctctcttcctgcacacacagaaaaataatattacatatgatttataacttaataataatatgcctaataactttgctagtcctagcttcatttgggattatgtcttctgttacatcctcagggtgtcatgaaatgagcacttgttagggtcagttaagctcaaacatttgttgaatgcatgcatatgtaagacacattgtgctaagcactgggttttaaagatgtgtgacatgctctgtcttgatgcttatagtcttatgtcttattaataatagaaatagagtgattttaggtgaaataagaaggttaaaaacaatacagctagttttcatgtcaggtaagtaagagacaaataaggacaacatgtggtatatggtacatataaaatggactacagatttaaagaaatctcagtctaccaatgttacattgggcaaggtatttgaacttttatcaatgcagagtgtagggaaaggtacagggactcttctggtttgcaacaggtcataagggggaaacagacattttctgcatgaacaattagagaattgtagggatacttggataaatatttattagtaataccattatttgtgtcaaacatggttctgggtagtaaggaaagtcttttttttttttttttttttttttgaagaaaggccagtttcatataggtaacaaactggaaaacctgcttcattttgccttggactataaggggcagagtggaaattgacagccttgatatccttgtgtggccctcgatgtatcagggccacacatgtcacaaggattggccaggaatgtaggcatgtaagtagtccagggagagtgctccttcaagtaacaacatggaaagaatcgttaagtgatgagtaagagatatatcatgttcaggcatcctaatgagtccataatatggatcttgggacacttttatgtaggagcttgtcagagaagtaaaggcttgtattcagtaagaaagcttcaataattgttttctcttttttacttctatagcggatgtcaatttggatatatcaaagcctttgaaagcaaacctgagtttcaccaaactggatcagataaacctttttttaaagaagataaaaaatgcacacagtttggcacatagtgaagagacttcagccatgtccaacaccatggtgaataaggatgatcttccagtctccaaatattaccgtggaaagttgtctaaacccaaaattcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggtaagtcacagaaaaggggaggggggagacagaacaagtaagatgatttgttaacatctgaaaatgcatcattttgaagatttatattatgtagaagttaaaagttgtaaaggccattagagatgaggacatttctggtttgtgaccttatttttagagataattttagaacaaatcctttaagtaatgtctaaacagaaatgttcctgtcctcttgaggcatgttcttccaggtatctaaaactgttaattcctaaattcctttttacctaaaacagctatagtggaacaacagtatatcaagttttatgaaccataagaagagtgtttctcaaagtgtgatctctggactagcagcatcagcatcacctgggaaattgttacaaatgcaaattctcagaccccacccatgacctactaaatgcaaaactctgggcatggagcccagcaatctgtgcttcaacaagccctataggtgattctgatgcacagcattaagtcactggtaaccatttacttaaaaaagaaaagttggtgttgtggcagatatgctacacaaagtgtaacagaagccaaggttcaactttgcaagaatgctgttgaggcattttatcaggcagcaacacctggcaacgaaaagctgtgcttctgtgcctagcctagcaaagtggggtacagactctgcaaagtgactgccattgatgggaggatatgtgagaaatcaactggcagtgacatctacattttccacttctgttaccatgactaaattgttatatactttttcaaaaagcatgggaagtgtgggcagaaggattgtgaggaggggaagaggaaaggcaagacacaggtgggaaatagcagttttcaatcacagaaactgctactgtaaaatttcagggcacagggccagaaatttggctctgaaagtaaatgtagcaaaagggaaccatgtattttccctctttaatttgtggggggaaattggggattggggatagtgcaggggataaagcaaatccttatatgcaacttagttgcttatcaaaaagtaattaaattgcagctgtagacttactgtaacttagttccacatagccaggttgggcacagtagttaaaacagaaaggaaaagttttatagttgagaagcctgaattttaggccaaaacatagatgatttatttctttctcactagaaatattcgtgaccaagccaactaaaagttctgtattttgtttaattgtcttaaaagttacaagtgaaaaaggtaagtaaagttcatgggtcatgaaagactatgaaatactggagactacagtatctgatttatccacaaataaattgcaacccagacaacactaggtctgttcccatgcctttccagttgtacctcaatcatagcagggaaaggttaagactcaaacaaaatggaagaatttaaacgtactatactcacttttaggtgcttttcttttttcatcctcattgctttttttattcattagttactcatattttatccatgtttaatgatgtctgtctttgggaaacacctctaaaatattaaaaatccttctctcactaagctgtgcaagttagtaaactctagttttggaacttgttttttccccctgtatgtaagaaaaactatatacccctaatccttttacaatgctgttcttaaatctagttaaacacaaaaacagcaactatagctttgactaaacatactttatacaactctaacatgtagtgtccagcaaatgttttaaaataattatttgcatcaagtcaaatcagagttgagattagctacttaatagtaacaattttgttatgagactataatgaacaccaaaatctatttttagtacagttttttctttatgcatactcaaacagtttaggatgataacaaggttagcaaaataataaactgtaattacatgaaataagatttattaacttctagttataaggactgatttcttggaaaattgtgattaagagattgccacatatttttttcaaaaaaattgattttaactgtatttttaaaataaaacataacttaagttttgaatgttaatttcattgtgtagttgaatgtcttaaaaattcatgctttgcaatttggataaaatacatgcaaacatatattcaaagtataattttgataagtggtaaaaactatccaccaccaccaaaaagcaaatatactcacataaaagcctcctaccagtagtcatatttctttttgtagttttcaagtaacattgttctacattcaactgaaattttttatactttagtatatctttgagctcaatggagttgatgtcagatttttatagtttgaatctaatacagaaatacttaactgtgtctttgattttacagtttatataactgttgtgaccatctgcagcagctgcacttttcagaattatttgctgaaccaaattgagcacagtgacaaaagtagtcatctcagatgtactattaaacgaaagaaaaaggagcattgccttggtacagtacagccatctgctgtacagatgttattgtatagaatgacttcagataaaataattgtagaaaattttcattaaaacctcaacaatttgcacttgtttatgtgaatctgcataactccccaatgagagaacacacttggggtttcttcggttctcactcactttctctttgatcctttttgatgtgctgattttaataaacacagtcaaaaacactgtgcaaaaacatcatggaaaaaactacaaaggaacaattatagcagcagaaactactctaatccctaacttatgcaagctatttttagtgaagtatttttttaacactctttatgtgacaatgttatataaacagggtaaaacggtcctttccagatgagttttaatttaggagccgaaatagatttgtaatgctagaggaatcttatgtgctaagtaatatttagagaaacaccattgagaatgtgttttagatatgtttctttgtcaaaggtacaaaaatatttgatttcacctaatgattatatgtttttatcatctaaactgtcataagcttacaggaagtgtatgtggaaaggaaataatatgatcaaaagtggtaagttaattttctcccccgggcattccgaatacatttaaatctgtgctttcagatttatttactgatttataaaactaaatatttataaattattgactgaagcagttaaaggaattcctcttattatcatttggaatgaaacgaaatggttaaatattttctactttaccaaaaatatctaccagttcttcttagcctcctatgttattctttaaccctaaactatgggagtttcataggatttgatttttttttaattccactctgcagatactggtatagcagtgacttagaataaactaactcccatttctgttagaatacttatgttctctcatgaatctttggtaaaatgacccaaaacttctgatttcagtagaggtaatgcttgtatttttaaggttggtgtataatattgctgaaaatcctatgattatattaaaagtacatctcctttagaaattatatcatatattttaaaatattttaaggcagataatatttattttgctattcattgaacccatcccattctatagtattttctgaaaacaaaacaacagaaaaaaagcctttcccttacgtgtatatacaacgcaatcatttttgccatttgaaatatgtagctttggagaaaccaaaagtatatagctataaattgcgaacttgcagtgtagcactttccagaggcagggtggagagtgagctacagactttagctccccttgtctgagtaaattatggctctgtttgggcggcactccttagatttcgacaaacgagcacacagttgagagctgtgaaatagctgaactttaggctgccttgctctttctcggggcacttagattggcagcctccatatatgtagataaggaaaaggaaaatagaatatgagcaagttaggtgccacaaaagattgggggaagaaccttaatgaggtcatcttggttggcattttagtcagaatagggaagaagttagaaggatcccctgtccataaggacttgggtgactttttacccaagccaaaaccagtgagttgaactccttctagtcaaaggactatggtttatgtaactttcactaccccaggctctgtcatccagatgtacttatctttttgaataaacaaaagtagagagagaaagcataaccacattatttttcacatatacaaaatgccttttctcatgttcactgaattcaggaccaataaaatgtaaagaacctaaagttccttttcatgtattgaaaagtgaaaccaggtcattaattgataaaaagtggagctccaacttttcattctatagttaactgggtctcccagggaaaatcttataaggcattgtcataagctttggatgctgcagagatgcgagttagcctaaggggaaataaaatagtaaattagatatgactacctaaaataatatgttgcaataaccagccaattacagcaccccaaagacttttgttacttttagcaagaaatagcatctctgtctaatgcctgaacaataggaaatgagttctttgacagttaaagccagaggacaaacttaacttttaagcagccactgaggattgaagtggaagtacagcttgtagacagctatacaaatcactaacaaaccttaatgaatattgggtgtgggcatcagggtcctgtcatttttgacactatgtcccaagtagcttaaacccaacacttaaggaaaggtggagacctcattgggtctgtaacatctgggtttttatttgtcattttggcataccccacaagcgcaaaagaaagagtaaaaggggattatcttgacaatgaaatgagttactgaatcttgtgataatgaaaagcagaagaattctaatgcctttctatagtccctgaggtagaggtgcgtttatggtttagcagaagtaaaatgtagaggggaagaacagatggcctaccgtccgtgaaacatgacacctcccctcccaggactgagtaccactattaatcctggtcagattccctcctattactttataacaaggttcaaagttgctactgataaactggcatgtacttcttttttcacccttagattacctgtagattactgataatttttgactatgatatatctctgtatatcctggtgaaccttgaggcattcgacaaaaagtagaacaggaatttctaaaaattggctgggaaataagaagaacaagtaaaattatcttaacttttttcaaaaaatgtcccatattatgttttctaatatgacgagaataaaaaccataaatgtatgagatactgtaattctcctgtcctcttagaaattatatgaaatggagaagacatctcaacatacaaattatattctccttgctgtaactgttatatgattagatacactaatcattattaattaccactaccttagaaaagatttttttgacaccctcaagaaaggagattaaaaattatgactgtttgacatttaaaaaaaagcactaggaggtatgtgctgctcagccgtgtttacatagtcatgtattgttttgtttaaccaaattatgtaaatacagtattctacatcttttattttgaggtatatattcattgtcctgtgataaatagcttgtgcatttttaaaatgttgtttatgtacatttttgttttagtgctgtgtggttgctatagctgttttggattccaaagggaagcctttaaaatacataggagaataacttcagagatatggaagatatccactgggttgagtttctgatgtatgtatttcaaagctgcataaaaataaaaattatctaataagcaacaaacttaggatatcagagcgatctcatgtgctgtggtgtagtgaacatgatgtacctgcccagcctttcgtagagggagatgagctcatttcagagagataaccatctctgactttttcttctgattcatcactgacctgaactcgatttgaaccttgttagacaaaaaacaagcagaattcctggcctaaactataaaatataattaagcccttttgaaatgatgtgtaaaagaacattgctgtacccccacttataaccaccaccaccaccaccgcaaccaataaagttaaatcaagcactgcctgtaatggattaaaataataaatgttcctggatttcagtgtttgaagtacttgaagaaaacaggctcccagcagccggggtagctgaatgcaagagagacatttattaatgacgagttcaaggatttggcctgtttaagatcattactttctgtttaccgtgtgttacacatcccttgtatttttacacagcccacatgtgtccacatgcaataatgagaagcttttttcccaacaaaggaattaattgtgtaaatatggttctcttggggaatatgaagtcttcataagactctgagcccttctaatgagaaatccagtgtagtcattatagtcttccatgtaaatccaccttcagatcttatctttaaccaaattagtcatttctggttattggttttagttaccaaattccaaatttaatctagactgtttgctagaaaactgctggcctcagggtatttgttttagaattgtgtgccattacattggacacataattccagccctaataattaagtactagagacttttttcttaatagcatctccttagcattctaatgatagcccctattaggttagtattaagtaaaatggacaagcactgtagccccaacccaaggactgtggaaaaataaaagattagaagtaaatctctatcccccactctactgaatttgtgacagcatttagtgttgcctgtggtcacaggaaattgcccgcttgtccatataagccagtaggctgtttgctaggaaagcttctagcaaagcaaccctgagtgatgagtaactgacaacatcttagatgttcttttactccctggttggtcccctggacttgttggctatgttggcataacatactggggctgagcaagggaactgaggacaggaaaaagcatgtatttacaacccagttaccaattagaaaaatgaaattactaagaactaatagcagtagtttgtataaagcaacatggtgctgtaaagaggcagacagaatctgcaccccagccctgctacttactgaccagctggttgtgtcaaaagttactctgtagtgcatttcccaaatgaaggcaaaaatatttaatttataggactttgagaggattaggtgacataatgtatgcagaatacccgacacattgcttggtacaaattaagtgctcagtaaatattggtctttgtatatattcctttccccaaaatcacaccacatgaatatggaggtcatagattactaaatgtcagagctgaaaaataccttaaaggtcatccttttttatcaataacctttattatccttttctcccattgacctcatggtctaggcacactgcatttagtattagataactaactataccaacttgatacaattttaaccaaaacaaacaaaaactttagaacacctccacaacttagtctcagacaaattcatgatttcttttaggttcttaggaatactaaaaatacctcatggaccaccattactatgtgggacccactaagtgtcaaggaaccttgggttgaagcccatggagctagtcttaactccctcattgagtacagagtgaagaggttaagcggtttgcccagggatactgtatggtggagttgagactagaacacacatctcctggctgctggcctttctgttataccagtctttcaaaacctggattatgtagatcaagaccattttctaaggcactgcagtaaattacttagcaagtcatgttgttttcaacattatttgagtaagtttatatcaatttttccatccatgtaacttaacttttttaaaaaaattgattcttcagcagtttcctcgcataattcaattaaccagctactgaattcatcccagaaacttttcaagtatgtatttgctattattctttcctatgtaagaaggttgtcttacactttccagtatgcacagtcagatctgccagtctgcttttttttttaaacatagccacatgatccaatcaagttatatttttctaataaactaacacaactgtaaaaaccgtgagcatggtggcagattggaggggaagaaagaggcaaagcatatcctccatcaccctttggtatttttagttttcatttttccaggatcctagagttctaaagcatttcataaaaaatacctttcccagacaatggccatgtgtgagtagccagctcagtaggcatttcttctttcatgacaaattcttccttttttttatgggaaagaaacactcctcttccagttacttgtttttccattttcttatgtccaaacaaagaggtttgaattaaactaggaggtcccagcttttacttaccagtaaggactaagtcacagtccctggggaatagaaatctcacctatgagaagtcatcaggtgctttgggaagggaaacatgttagtagcctggccacccatttggtctattattttgatgactagacttttaagttcatttgttggggaatactggcatcttttacagcttaaatgtcagtgtccatgtagttctctggttttgttatgttttgtcccacatatcatttcttcctgtattttagtttaccatattaataggttctctctctctctctgtctctctctctctctctctctatatatatatataggctctctcttttgcgctctctatatatgggcttattacagaattaaatataattaaataggatctgatcaacttacatattctgatcaagggcggggacgaacatgtttttttcatggctagagcacccaaatgccatttttatctgcttcaacataattggttgaaggaatggaagactttatttttgagggatttgttatgtctttacagacaatacttacaaaattttgtcgttttcacattttaaggttttctgatgcttcactgttatgcaaatcagcttccggatgtatctaacacatgcttgctgattttctagtagccttagattacttacagctggataaaataattacctggatatgctttgctagcaatgtcatcattgactactctttctaatgatgcatagaagcttgatttagattgcattttgcttagtcagcatgtagacactaggagccttactaagggtctagtagacactgacaacatagggctggcagcactttgtaaacattttccaaaacaagtggtttgcatttattagtcttctgaaggagtattttagaagtcatgaaactatttgttccttgaagtaaatttttatactcaatgaaaagtatgtcagtattcaaacaaagcatgattggttctgtttatcgtaccagttgtttctgaaattatttctcaatgttgctacacctcgtttagtttaattaaatatctgccattagtttgctaaaacttaaatttaaaagataaacagatttttgagaaaagtcaacagaaaaaatcagcaggaaagcattctgttgaaggaaatgtagaaagaagaagtcataccgtacgattggtcaaagtgacctgatcacataatcactaaatgcaacatgggatcctgagtgggatcctgaaacagaaaaaggacattggaggagaagctggtgagattgaaaggtctttaaattggtagtattgtatcactgcaaatttaatggtttttgagaatcataatctgattttatgtaagttattaacattgacaagctggatgaaggatatcaacttttctgaaagcctaaaattgtttcagaatttaaagtttttaaaaaatgacctgatcagcaattgggtaagtaactttaataatattcatgcttttaaacatctaagtgatgattttatatcgtaaacttttgaagcatatttttaaaaattttgtctttactgtttttggaaatttagggaaaaaactacaagtacagaaaatgtacagggtaattcatcaaatgcctgtgtactcatgagctagaacaaatataaacatttgtcttatttgttataaacacacacacacacagaactttacaaaattattcaggccttttccaatgttccattgttaagaaggtagctctttataatttttacttgtaggcattttgtccaatggtgcatttgtccccctaggaagaagaacacatgtcttaactcactttctgttgccatttataccaggttgttggatgtgtaaatatctagtttacatgaactctgagtattctctgtggccctaggtttatatgtgtggtaatatataagattcaaaataaggaagatatttagtatgtttcctgggaaaaaaagaaaggcctgatgtcccatgggctggcttctcagagtgaaataaaggggaaaggaaaattaataaccctgtcatgagtcccagggattactttcgtattttgtggtaaaagtgtataatttggtttactatcctgtaagtgaccctttgtgaaattcatcaccaccctttattgctattaagttatcacaagctcttaataaatactggctcacgcctgtgatcccagcactttgggaggccaaggtgggcagataatgaggtcaagggttggagaccagcctgaccaatgtggtgaaatcctgtctctactaaaaatgcaaaaaaaaaaaaaaaaaaaatcagctgggcatggtggtgtgtgcctgtaatcccagctacttgggaggctgaggcaagggaattgcttgaaccagggaggtagaggttgcagtgaactgagatcacacactgtacaccagcctgggcgacagagtgagactctgcctctaaataaataaatactggttccaagattaaaagcacttaactaatgtgtttattattatgttgtagctttttttaatgtaggagtaaatgttcaaaggaaatatctattttaaacttaaaagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttccttgtaggtatatggcaagaaagaaaagggacaaaaaggaccaggcaggatatatttatatctgtagattttgtattttcttagtactttctggcaatggctgttcctgtgtcctcactgcaaacattagcatcttattaaattctcagtgtcatttgtgtatttaaacaagctcatgatcagtgctggtaggcctgagttacgggcaaataaaaactgtagaatgactgtaaaaactaagactaaagcaaggggtaggcttgagcaaaagaataaaagagactgaaaaaaaagtgaacagcacataaagtgaataaaaagaaagcaaaaaatattagggtttgtatgatagcagggaagtattcctgttcaacagttcatgtgcttaacagagtcaatattagaaatgttctgggatgtctcttccccactcagtacttactgagattgcagaccttgaagctaatacattgccaagagaaaatctgatatgaaagaaaattgctaattatttactttatcttcatatacccaatatatggtagataaccactaacttttggttgaataatggatacatgcctacataaatatcaaattgaaggtgacccaggatatgtaaattccttagaaacaatcagaagcatggtaatagcacttgtttaagaaattaggcctggttttagatactgtctcataaggacagaaattatggtttaagccatgagagtagagaagtttgctgaaatattagttcaaggggagaatagaaaactgaagattacttattaaaatcccattggttaaagatattatttgtgacactttggattgcacacgacagaaaatccaacctaaactggtttaagcagtttttacgtatgtgaaaagctccaaaccagtgttgtcctgaggcatggaagagtctgtcagatttcttccctctgcgttacgcagcttcagcccttaggctccacatgctgactgccagcagttccaaggccttcattttcttaacctcaagaccagggagcaagaggaagggtcatgttcccaaaagtattattataccttagtggttttcattgaatattatgctcattcctggaccaaatcaatctccagagaatatcaaacataaagtcccataaagttccccatcctgctagactatttcccggcaaaccagtcattggattccgttgtcaccagaacatagctatagctagctcagtgcctgccttcattgcagggcctctgtttctgaagcacattgtgtgtcctctggtcctctttagtgctcacctaagtctggccgactttctctcttcttgttccagcctcccaaatgtttgtgtgatcattggcttcctaattctgtgcaattttactgatatttctgtccccacctttatctttattctcttgagaattctagctatcccattctgtgtccccaagccaaaaaaaaaaaaaaaaataggatttgtgtaatagtaggaaagtgtttttctatatttgttttctaataattcaagtctggaatttttttttcattctctccttgccctagtcaataaagtcaataagaacttgtaattgtataacgttgggggggttaagaagagccttccatcaactctacttaagttctctaagaggtaggcactttgcaagtgatatgcatcatatagaatgatatgaattttgacatttcagtactagttcttttaagacaaagcctcataattttagtacaatatcagtatttagcacaatatcagtattttaaagtggttcctgcataatagagatacctaacatgatccaaattctatatgtattatgttatttctacaaatataagattttgtcatgcttacaaatactcttttttaaatgaaagccactatagcgtgagaaaggaatctcattcctctgtatgctttgtagacaaaatgttgtcaagcccattcctaaagagacttccagaaataaatatcaaccttttatggcttttttttagtagataattacctttgcttccataaacttgttctttatggctttcttagttcttttgctttaattttgaccactccaagtgatgttttaaggtggattagaaacagacacacctgaagaggtgcttagcaagtttctgatggtcatagaaagaggttacaaataaggaaggcgagaagactagaaaccaccctgtgatgttggatttgaacctgaggtatcagtatgcattcatggtttttaatgtatttaccagtggatagagagagagacaaagatatgtaggtatacaggggttgctatacatacatatacttcttatctctgctgaaggggcctagcaacagtgacaccccagtagcaatgagcatacctaccacccagattttggtttctagataccattcttcaacaaaagaaaccagagctccttggagaaatggctggtgctagagatggggtggtaaaaatacaagatgagcctgaaatattttgtggcctgaaagtaaagaagttctcaaaaaatgattggcataggccaggtgcagtggctcacgcctgtaatcccagcactttgagaggccaagatgtgcagatcaaccaaagtcaggaatttgagaccagcctggccaacatggtgaaaccccatctctactaaaaagacaaaaattatccgggcatgttggtgggtgcctgtaatccaagctgttcgggaggctgaggcagggaatcgctggaacccaggaggcagaggttgcagtgagccgagatcatgccactgcactccagcctgtgtgacagagtgagactctgtctcaaaaaaaaaaaaaaaaaaagacaggcatatactaaaaggacacagggaccatcttaaagggctcccaatggccaaagctggttcagagtaagcaacaatgtaaataatgatagtattggattataacccataaaaatgaatattcatgagtccatactgatataaataaataattgaattagtatatggggtagaagggacagctgtagtatatgtgctaccaaagtgggcgctagaagggacagctctaaataagggaaataggaaaccaccattatcacacaccacaataaatcattgcaggtgagaccactggtggatgctaacattagtgggtgaaaatttgaagaaaaagagcatatctgcataatctccaagtgtctccccacaaaaatacttatttacaaggggaaagtgttaactttacaatggcaaaatctgacagacaccactttagccatatgatcagagttaatattgtaaataataaaatattggtatcacatacaccaatatgacgcactaagggggtcactttggtggtattgtcaaaaatgcataacctctttctgatcacaagaaaacatcagataaaccccaacagacagacacgttgcagaatgattgtcctgggttattccacagtatcaaggtcatgaaagacaaagaaagctgggggatgtgtcacatattaaagaatattaagaagctttgatgattaaattcagtatggatcctaggttgaatcctggaccagaaagaggaaattagtgggaaaaatggcaaaaatttaaaaagatgtgtagattatttaaaagtattatatcaatgtggatttcctgatttcagtatttgtactaaaggtacatagctaggtgaagggtgtacaggaacattatacagtatgttttttcaacttttatgtaggcccaaagttatttcaaaatagaaagctttttttttttttaaagtgaggggacttggaatagatgatttctagatctcttccatccagcctttttatgttacagtggtaaaaaacgaaaccaaagatgtaagcagttttatttcctgtctaccaattaagaaacatgttgaggcagctgaaaaataggatcagattctaaactgtcgattcagttcaatggaacatgtcctgaatagctactgttgtgcccaggactacactgaataagctggtccttgcctccagcatggtcagtactagaggttgaaaattgtgtgatcttctctttcactcactcatattattcaggtatctcttctttgatgttttaaaataatggaattggagagaatgaaatagaaattgataagttttagaaatttgtcaaaggaaataagagccttcaaagagggcctgaggtttttcaatctgggtgcctaaagagataataataaccattaaataagataagcaacctaggtggcctttggcattaaacactgtgtacaaggattcaatatgactatcacactaagattacaaacagataattagatatgtcactgtggggttgtacaaagatatgtgtatttgaaaataaaggatgatgcaatcctgacattctgttaatgctcatttactaaataattgtactgaattaaggctatacttttatgcctttatggcaaatttctggatgatgaatagatatatttcatttagcaaatatttacttttagaagttttagatattttagaaatgtaatgctgttaagtcagaaaattatggcttcagttatggactgaagttaataaagatggttttttatttgggggtattttggggcctgtttctatttcttttattttctggagtgctttttttgcttgtttatttgtttgtttagactaagtggaagctttgaatcaggataattgtaaatgaaatggtagtttcagtttcacaatttgatgaaacattttaagaaattgatttccaccatgattatttttaaaccaaagtcttatctctaacacttttgtgggtgtgatgccttctgtggaggattagaggttgaatatcttatttctgcagtaggaatatacaacatatatgaaattttcaagtctctacagaattgaaaagtcaatgtggttactgtactttaaaacatgtgtatactgtgggcctaaggtgttttttaatctttcatcttttttagggatcaaatatcattagaaaaataagccatgggcattacaaacgtggtctggtgaaattcaatattcactatgacaatttagaatatgagctccttgggaggaaagttaactcaccactcttaactttgcatctaaatatcctaaaatgtgccattggttttatgaaaaggttttgatctacactcctattttaagttcaaaagaaagcctacattttaaagtgtattccttttctgggtatatttactttgaactatagcatatagtttttctcataaatctaacctgccactatctgtttttaagactttgtaaacttcaagtggttatgatgtgtgaagtttggattaaactaaaatttttagaaaacacacgttatatattttgattgttttgaattttaacatgggccagtaaaaaacttgagtgtctagcagagtaacatactgcactctgttactgtaggaaatcacagaaaattaccctttcccatcatgttaacaatagacaaatgaagcagctgttcttattcttaatgtagttgcttgaaaaacttgcacaatttaatgaaaatgtctctactcataaaacttaaaatgctcacacatggaaaaagtcataatgttttggcaaatattactttgttaggaatgtgaatgaggtatacctgcttcataactagaactctgtataaacggcatgaaacggtggtggactgccaaccaagcaagacgactctgacaaaggatgaattaatactcttcaaaaatatagatagttctttcccaaacattttttttgataaggatgaattatatactcttctgtatttttttttcaggcataattcttgggtcatcatttctactcagtataaacgattttctccttaaaacaagtctcaaagaaagaagccgcattctgataggaccatgttgtgctactgccaatctggaagctaagtggtgtaaacacagcgggaatccaggcccagaacaatccataccaaaaatatccattgacttaagaggaggtctactacaggtctgtgggtattggccatatttttttcataggttattaactagcctctgttcattttttgaactgtttcactaaattttaaatctttgtgtggtaagaaagggtatttgtcagattgctacttgttaaattttcaacaactttattgagatataagtcatataccagcaatctacctatttcaagtatacaattcagtggttttttagcatattcagagttgcacaatcattaccacagtcaatttcagaacattttcattaccaccaacaaaaaaacccatatccattagcagccactcacattaccctctaacccccttatcaggcctaggaaaccactaatctactttctgtctccatagatttacctattcttaacatttcgtataaatagaatcatgtaacctgtggtcttctgtgaccgacttctttcactcagcatgttttcaaggttcatccatgtttaccaagtgtcaatattttattcctttttatggccaaatgacattccatcatatggatataccacattttatgtattcattcatcagttgatagacatttgggttctttccacttttggctgctatgaataatgctgccatgaccatttgtgtacgactttttgtgtggatatatgttttgatttctcttagatatataactaggagtggaattgccgggttgaatttttttttttttatgggtagacttttctttttgagacagggtcttcctctgtcacccaggctggagtacaggggtacaataatagctcactgtagcctcagtcgcctgggctcaagtgatcctcttgcatcaacctcctgagtgggtagaactatgtgccaccacacccagctaatgttttttattttttttttcagtagagatgaggtctcactatgttgttgaggctatagatttttttaattattaatacaaagtagtcaacctgttgcaagcacagtgtcactagcaatatataagaacaatttcctaatattaaatattttacatgtgatgatatctgattacaacacttgataaattagtcacactgcaagctcttaatgcatttgtcttaacagccaaatatagaatgtgtgaaggcatccaacttatttcttgattattttgtatttggatagattttaatttaatcttcatgtaacttgatgccactctaaacttgacatgaatccaaaaagcttgaaagattcacaatgatagaaaattaaaacaactaattggtcaataatggagacattaaatgtgaatttttttctttttttctttttttttttttgagacagaatctcattttgttgcacatcctgaagtgcagtggtgtgataacagctcactgcagcttcagcctcctgggctcaagagatcctcccacctcagcctcccgagtacccaggaccacaagcatgcaccactatgcttgactattttttttaagagacaggttctcactatgttgcccaggctggtctcaaactcatgggctcaagtgatcctccacccatgctgggattacaggcatgagccatacatagcacccggccaattttttgtatttatctaaaagttgtattgcctcaagttttcaccagtttcctttttaatgcacagagcaagatttgggaagatcctaataacttactgttttgtgttgctttggagattttcagtatctatcagaaatcttcatatatttagcaataaacatgtattactttatcaagaatattcattgtcttaccttttttccaaggcagccaagtaacttcacattgaaaacgacaatgatctgtttacatgaccaagtgcttaaaaataaaaagtaagaaaattttaaaccacagcattaataaaagcaaaaacaaagtacagtgtattacctctgtattacagtcattgtctcttgacaatttaaaggctagagcacaacattctactccccgtttgacttttcacctgtctctatttttcagcatccaataaaaataagattgatgagaacacaagtacacttagtgttacatcttttactttcatttctgagatgccttaattccagagagcagaacctaaggctagggtttaaaacttacccacacgatatggggctattattttctactactatatattcttttttcttttctgcgttacctggttctcttagaattgatagttgtattgcctttattcagtatttacagagaaaattaacatttttgaaagttttaatcttcattataacctactggtcattatatgtctataacttagtagttatagactaatattactcacatgcagaaaaataaaacttaatctccattagaggaaacactaagtccttttgttctgaaactctactgtagctactgtagtataattgattttcaggggctctggaatcctctgtgttggcacagtcttactaaacacagaagttgggagccttctaagttcaggttcattgagaaatctccctctaaaagtgcagagaaagaaaccctataataaggattgcttatttaatctcatggcagaatgtcagagctgtcccacaaggttattattatgattttattaacattttggcctagaggatcttcattgccttctctcagactataataggtgttcttttccctcttagctaaattaattcataaacattacttcacatcaacataatttcaattcaacatttaaaatttattgttattcacacaatataagatataattaatttttttgttgttatatatttattcaagcaatagaatttcatcctgtaagtcaattactttttaggaattatagtttataagtaattaaattgaacataattacagtcctacattaattcaaatatgattatacctaattagtctcaagaaatgtttgtatttaaaagctactagaatttttttatgattttaaaggtcttctggggtcaagaacatttgaattgtttagttcttctacatgaattactcaatggataccttaatgaggagggaaattttgaagtacaagtttctgaaccagtgcctcaaatgtcatctcctgtggaaaagaatcagacatttaaaagtgaacaaagttcagatgacctacggacaggtctatttcagtatgtacaggatgctggtaagtagcaacagactcagtatgagagtgtctctgtgcatgtggttgcattttaaatgcatgttgactaaataaaaacaatcaagatggctttttaaagtgcgttaaaatttgcagtacaaaaatagtacattatcattcaatctctcttaggggaagttcttcatttctttctgttccagaatatatataaaaatgaccaactagcttctttatatcttttattctcataatttcttcttcctttactttttcccctttgtcatgttcccctttaaatcatacaattaattatacttttatttgacagaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggtatgtaatgaccattcattgtaaaatgaaaacattgtgggaaagggctgatcatatattaggaaaaatgtttggaacatacttacttcttacattaatagtatcagagagaaatacacatctgtgtgtgtggtgtgtgtgtatccacacacatatataatgggattttaaaaaataaggtaataatgtaatccaaattcatgatacatggcaattttaagagttctcaattctactctccattttattgtgagtagattataatgggacaaggaggtgtcatttagttcaccactcctttattaagtgcctatcatgtgttcacactcttcagagtttctagaaccgccccatgaaacaaaatatgcccatgtaaggctagaaagagatgactgtagttttcatttccatagctgaaatggtcttggggcttgaggtaggctgatttttctattaaagaaaaggtctaacctgtgatcatattccctaaggttttgtgaaagtgtgttgcttgttattccgagtttaatataaatgtcattgtggatatcactatgttatctttgtacttactaatgttctactgataggagtttctcttaaaatttgtttctcccttaatcttccacctattaccagatcatacaaccatccactcaaaatctacaggtcattcctgattgccttctttccctacttccctgcgtcaaaacccatcaacaagtcctgtcagttctgcctacaaaatatgtccctattccatctacttctctgtttctgctgatacaacttgagttcaagctgccatcttctgttccctactccagtagcttcctaattggcctctatgcttctgttcttgaccacttggaatgcattctccaaatagcagctaaactgatattttttaaatgtaggttatactatatcacttccctaacttaaaaccctgtggtgacttcctctaatacttagaacaaaattcagatctcttgctgtggcctgcaaggacctatagtctggactctgctcacctctccaactggagttcatgccagtttctccctttctcatgatcctttagccactctggcctcctttttctccttgagcagaccacctgtcacattaccaaccttggtcttcgtcagtcaggtaccagctcaaatgtcatatcctgactagcccactacaactacttcattctgtattgcatttccttgttttgctttcttatagttcttactgctagtcctaattatgcatttgtttacttgcgtgtgatctttctactgttagaaaataagctccttatatgtcttgatgatgtatctccagcctctggtacataggtacactcaccaaatgtttgaagtgactgctctgttcttaacaaattagttttataatacaaatcagctacatattaatataagtcatattacaatcttatgtaattccttttttttttttttttgagacagaatcttgctctgtcacccaggctggagtgcagtggcaagatctcggctcactgcaagctccgcctcctgggttcaggccattctcctgcctcagcctcccgagtagatgggactacaggtgtccgccaccatgcccagctaatttttttgtatttttagtagagatggggtttcaccatgttagccaggatggtctggatctcctgacctcatgatccacctgcctcggcctcccaaagtgctgggattacaggcgtgagccaccgtgcccggccgaattctactgtcttatcagacttgcctaaatgcagaatatctgtagattttcaatcaacatgaaaatacgcatacattaaagttttaacttcatgtaagggctaaaggtttatagttatagctagatattaacacatttattaacataagtgtaataactaattattggtggtatgatgtaaattatattaattaaggcatctaagatagtacatttactagtggcatattttctatcttctcacggttattaggagagcatagtgattaagaggatgaactatagccagaatgcctgggttcaaagtcttgctctagcacttgcaaacattgtcacattagacaagtaacaaccactcaggttggatttttgttttactttttattccaacaacaaaatgaggctaataataatgtgatgattgtaagaatcaatatttataaaatacatagaactgtgcctggcacatagcaaatgttatataagtatgactattaccactattacagattcagcagtctaatccaaaaatctgaaatctaaaatactccaaaatccaaaactttctgagtgttaacatgatgctcaaaggaaatgcttattggggtatttcagattttgaatttatggattagggatcttcaactagtacgtatttgcaaatattccaaaatctgaaaaatatctgaaatccaacacttctggtccctagcattttggataagggatactcaacagatattatgatgactattgtccaaactcctttcatcaagtagaagcacaggctagaccaaggagatctggagtatgatggatgactctacagaccagctggagtagtccaggagatcagagagtcccagggacccagacagtagccttggcatataagcaaaacacagcctggcagatttcagcaagcaaagagttggtatcaaaaaggtcttgctatgtttcatattttgttggagaaatgaagatcctatatgtgggcaaaattcaaagacagggatgctggcctagggagcaagacagggttgtaactaccagaagttagaaaggagggagagctggatcctagtggtgagaaggagcgcactcagaatctacaacttggatcgaggaacagatcaagactggcaacgaggctgacttgataccaagctgctgagctctcagttcaattctcatactctcccagataggagcagagtttgtcccagagcttggagtgggtctcatctgtggaaacaactctcttgagttgcaatattagaacgatacaaaatattttgtttcattagaacttcagttgaggacagaacatatgtaacatgaatcacaagtttgatttaatacaacagctttctccttgaggatctacagtgccaggccctgggcttgctctgggggatccagagacagataagacacaatcaactcattaaaagctcaatccttcagtctagcagggaaatttctgtggtcgtgtggggtagaagaatctaatttcatctgttgtcagaatcattctcctaccatatgtgattatttctggttctatactagaggcacagctaaaatcctcaacagctgatcctgaatttcagggagcttatgaaaggaaggccctaatcaacctagtgtatattataaaatgggttttgaagtctcagttgccactgtctccccaccccccgccttattttaactaactcattgaccttgggcaaactactgatctttttgagcttcagtttcctcaactgaacattggagttgatgttatctacctttcacagttgtcgtggagtattatatctaatacacttaaataaataaatgcattacacatagtgagctcttaataagggcttgtttcctcccctccgctttttcttatcacacaaatgcctagaccactaaaaaagactcctagatggaattccaggctccagtatctcttccttccagcctgtccttctaagtttttagaggaacaaatagattgtataattccctgaagaaaaccttcagtggctctgttactctgccagactgaccttgagagcccggcataaactgcccccatcccccaattttgccttgcagtcccttagacatggtctgtcctctatcaaactggcctatctggcattccccaaaccaacctataacatcctgcttcctcttcatttgaatccctcccatctctgccagctgaattcctccccacacttcagaagagctaaaatgccatgtagtcaatgaagcctttcctagatgccatgttcaaacatgataaagccctcctctgaaatcttgtagcacttcatggtactacttttatgctatttttcactgtattcctcacacttgaacttatgtgtccccatcttgtgtctctcctagattgtatgtctgtaaaggaagaggttgtatctaatttgtcatcatgtcctttacagcagggtcccccagcccatggcctgttaggaaccaggccacacagcagaaggtgagtggcaggcaagcattcccacctgagctctgcctcccaatctaatgagcaggggcattacattttcatatgagcgcaaaccctattgtgaactgcgcatgtgagggatctaggttgtggactctttatgagaatctaaccaatgcctgatcatctgaagtggaacagttttatcccaaaatcatctccccaccccttggtctatggaaaaattgtcttctatgaaaccggtccctggtgccaaaaagattggggaccactgctttacagtatccatcgcagtagagatgttcaataaatatgttgactggataaacgaatccatgaacttccgtgttctgtttcatatcattcaaaagtattacattatatatcactattttatggaacgaatgaatgtgttttgattttctacaccaaactatatcagggtgcgttgtgttatttttcagtggtatcatctgtacacacagtctaatgtcattacattactcaacctctttgtgatatcattgaatagtctgccaagcttacctgctcccttaaacagtagctaattcttaaatacagagatatattaatctccttaggtttagtcctcaaaacagaattgagtttagatgactttttccttcaagaccatttaattcacttaaaaattggccttatagagttggcttataatacagaagcctcagatttgtctctttatattcctcattccatgattgttgatgagatttataaacaaactccccatatcactttatggaatttattttgtaattgtaatgaaaaatataaacatgaaaaacatgtctataataataaatcaaactaatcataggttctgaataaaaacctcaaaagtaatgttcctagaatgcaaaagcttattttatggtcagcttataattttatcatgtgaacttttaaatgttagtagtatatttagatctcaataaaattagcatctgttagataaagtaatgccaccaacctaggagtgttgtgcagtttaaatgggtctcaataaaagaaatttctggcactgtatatggcacatagtaggttttcctctctcctaatcctcctgtgtgcactgcctattgaggattccattttggaaatgcatatgttcccagattataaatactcaatccattttttggtagtaaaattggtaatgggtattttaattcctatacagatctgtcatggttcttggccattgtcacatgccaaatgaagatatctaaaagtttatggcaacatataaatgaaaataaatatgaaaacaagaagaatacaatgataagggaacaggaacaaattcttaagattgaaaatgccttttttaatcgagaaagtgttagccacacctggctaatttttgtatttttagtagagatggggcttcaccatgttggccaggctggtctcgaactcccgacctcaagtgatctgcccgccttggcctcccaaagtgctgggattacaggcatgagccaccaaaaattctattatttataagttacccagtatgaagtattttattatagcagcataaactttctaagacacagagagaacctaaatggtagagatctctgttatttttgctccagtgggcatttctgatcacttgtgtgttttgcacccagcactgtgctgggtactttacatacataataactcattaaatttaattttactccatgaggtgggcctcattcccattttacaagtaggaaaactgaggccaagaaaaagttaattaactggttgtgaatcacaaaatttataagtgagggagccaaaatttaatccccagtctttctgactataaaacctgtttttttcacttatatgtaaaaaattgagatgatacattagaatgacagtgagccacctcactgagaaatgtggaaagaaggaaaatagaattatccttttacttcaaatgttaaatcatgaaataatgagttagacaaagatatgcaaagtaactttaagtcaataaaaagactgccaaacacacaagatggattgggtattgtattagtctgttttcacactgctgataaagacatacccaagactggccaatttacaaaagaaagaggtttattggacttacagttccacatggctggggaggcctcaatatcatggcagaagacaaaaaggagcaagtcacatcttacatggatggcagcaggcaaagagagagcttgtgcaaagaaacgcctgtatttaaaaccatcagatcttgtgagacccattcactatcacaagaatagcatgagaaagacctgccccctgattcattcatctcccactggttccctcccacaacacgtgggaattatgggagttacaagatgagatttgggtggggacacagagccaaacagtatcaggttttaagatagctaaagaaaaaacttttcctttaggaagatgactagtcagctctggagcccaggagggtcacagaaatatttgttggaatagatcttcctggcagcaaccaaagaaatggtgcctaagagtctggttcacctggtagctaaatcccctttatggaaatgaatgtagcagctgtcaaatctctatgtctaacattcaaatcatgtaaccacctaaatatccttctaatagtttggctcccagtgtagtctgtctacatggagaaagtatatcatacactggttgagccaacatcagtatccagactgcttggcagttatacatctcatggtaacttaataacataacttggcattttgtttatatgtcagtctctagtgaactttgttagcatgagtcagcattcctaagtctagtcagtgctagaataccactgaaattttctgagactctaggaccaatggctagatcttgaatgatggttaatccatcacattaaatgcccttttcattaaatgcccctcccagcaggttggcctttccctgatgacatctctgttcaatatgtcacaaaccttttcaaacaaatgtctattctcactaccttaagagttatgaggagtggggataatgtgtgtggagcatttagcgtaatgccttacatagttgaagacccaatcaattattatgacacatcataaatggtagctgttaccatcattatcttctttcccatatcaattgatcaaagaatctgggattctaatgtgttagaccacattagacagacaaagccctgttttctgagaaggaggtttttgtgtttatagtctgttaatgtcgtaataattgttagggatgctggctctgtgtgtgattgatgaatgctttcattgagagcaactgctgtaagagacactatcttccccacagttatggttagtggactctggtagtatgtcgactacagttctttaggttgcaggtagcagaaaccccactgaagttagcttaagctaaaatgagggggattaatatcaagatacagtgggcagtcctggaaacaattgcaaattgcagcagggcctctggaagaactggggccaggaatggaagataggaacccaggggaatattcactcgctattgctttttctctttttctttccccgtatttgctttattcttccctttcaacagactttttttttctccctttcttcttaggccacccagtactttccccacagcttccagagctccaaaagtcacatttacaagtccagcctctgtttcagatccacattcgtaatttaccaagtttgatatcaggtgctcttggcccagtcaactttggtcatggggagagccacgttttaccaacacggctgaatttggggtcattgtgagctttacagaaatttcccaggggatctattttatgtcacatctctcttactgctcttgctttccaccctggctatattgggcaaactcatggtttgtgttgacctctcactgacaaaaattgactcaattttgctgtggtttttccagcttttccctttgcaaatatctggaaaagacattctgctctgcacatcaaaggctatctgcatctggagaaaagccttacaccatttttaaatcctgtcgctgtcttcccctagtatcctctcaaaatgtaggttaggcaaggtcctttgtcttacagacacacatgagatagtttcttatctccagtgtgcttaagatcaatacctttcttgactagtgcttgctttttagtgcaatgactatgtaatacattggcaacttcacagattctatagtcttccagttctaatgaagtatgagagctttacatataaagtaattttctttttttgaaattgagtttacaatgtaatgtttaatgtctgtagcttgatggtgatttcattgtgtttagttttctaataatattttatctactacttgtccacagactgaactaaagcttcattaaatcttatagttgtgtggggtttttgtctttttcataattacatggaaaatgttctgagtcagatagtaatagtcagtattatccaataaagtagaaactagacttttgctgctttaaatttgactttacaagcttcccgtaattttgaagcacctggacctgataggcaaaggttatgatattagcacatgatggcactacaaaaagagaatccttctgagagttatttgcaattgaatatgatttgcctcttccacacatagcttaaaaagaataaaaggaagtgttcttggatgtttcttttcagctgggttgggcagttcacttatagctgcacatatgttcccagaatcctgagcctttttataagcacctcctgcccactggcagctgtactaatgtgtcccagaaggctttgctcctatccatcatctttaggagggatgctcaaagccagatatgaaattcattgttgttgaaatgcagaaaggaaaataaaaaggcctgggggctttggggaagtaggaggttgagccagactcttaggaaataaaggaaaggaacaagtcttgtgtatccagtggacacaataataaatgtttttgaatgatgggtaacggtgctggatcaactgctaagtgttttgcttccagaagccattgcctcctttttttagacaaagaaaaatctaaaatagagtgttccctgaatacacttttaatcattctgtcttcataatgttgtaaaagtatgaaaaaaagatctaggaatacattaaaaagagccctgcctgagatttttgagattaactcagtaaatacagatgaaaggacctgggctaaatgctgagagagagacacaaaagtggagagggctctagctcttctctcctgaaaggtacctgtaggtacaggtacaggtacctcctgaaaggtacctgtaggtacaggtacaggtacctcctgaaaggtacctgtaggtacaggtacaggtacctcctgaagggtacctgtaggtacaggtacaggtacctcctgaagggtacctgtagtctttcaggagggacaagtacataaaacatgacagggcagaacctgtgacatgccacgaaaaagccacagagaatctgcctttttaaacgaagcttacatttgaattgagacatcaagacaaggcttcatggaggagatggttactgaggtgatccttgaaggatgaagaggattaaaactgaaaaaaaatggagtgaagttgtatataaagaagaactcagtgagcaaaatttcagaactggatagagagggcagaacatatttctgggaagtggcaaatcatctggtttgactagcacaggttagacaagtatgggattagtggaagagtgagtgagaggccgcagatgtggcttcttaatctccattcattccatggtgggaaaagagaaggaaactcattttttgagcacctagtatgtaccaagcaccaaacttgtcattttatatgtgatatcccttctatcttccctctaaccttgtatgtaccattatcttcactataaccctgtgtggtatgtactgtttagagctaaggtaaatgaggttctgagaaaaataattttcccaagatcataaagcaagttaagggagtaaaaccaggattcaaatctcagtttgtcgatttcataattctttcatctttgttgtgctaccttgactacatttagagtgtggggtttatatttcatttgataggcattggagaaccactggcagtccagagctttggaaacattagtagtcttgtggaggtgaaatgaatcaggagagaccagaataagaagacctggtaagggtcttagagagatgagaggctgcaacctgaagggagtagtggggaaggagaaaaagaaatgaatgcaagagaggttatagagaagaaatctatgttcttgacaactaatatggtaatttaatgaggaagtaagagaagtcaaggtaattgcaagatttaagctcagtgggatgtgtggcaaaagcattcacacaattttggaaataaagaggagtgcctgctatgctaggcactattcactttgtgaggtgctttacacacattctatctaagcctgaatcaaccctgcagagaaagtgttgctatccccctattacaatgaagaagctgaggatctgaaaagttaaatgggggacctcctctccctgagcagtgcatgaattaacaagagatttaacatacaatttcaggaagtttatagacccccctataagccatgaaagagtctctcgtgaagaatcacaagaacataagagacactgctggggcttttcagctctatgtcaattagtattaggtttagatatgaaagacagaaaatatgcaataccagtagcttaggtaaaatagaagtttatttcctttcacacatgggaacagtctggaggttagtgatctaggactgcgaatgtctctacgaagtcatgaggacccatcttcctgctgtatgctactctgccatccccagcaccctttccttcatggtccaagatggctgtagaagcttcaagcatcttgttcctgctccagccacaagaataggaaaggaccaaaacagagcatgcctccccgctttatggatatgccttggaacccacacactgtcctgctgtgctgctaacatcccagagcccagaattttgtcacatggccacaccaagttaaaagggaaatggggctcgtttgcagaggaagaaagaaagaggagatattgggagacaacatcagccctgctggcatcacagccataacaccaaggaactgtccacagtctctccacccacccagtaaactgcttctcatcttgcctgattgtgagcttctttgtctagtctatggtgcagtaagaaaactcgctttccagttcattaacgaaaggtctgccaaggcagaatttgtagataacacttaagaagcaaatgggattttcgaaacaaaaaataataataaatagtttgaaatgctagcattccttgcccttcaaaaaagtaagaggtggggaaggaatttgtcagtaagacgtgcttttaaagtaaatggaaaacatttgcaaactggaagaatactgaagtcatttttatcctgtcactttatttggtggtagaaattttattagcctatttctcttttcctattaaatactctcacatttaaaagggggaggggagcatttctcaaaatgaagaactatgtttagcaatcagtgtgtttgatgttcactgctcagtattaaaaatgtttggggtgtaaaaaatgaaagaatagtaaatatgaattgatggtctggtaccatcttttatgacttggtctctgtcaaatagaagtatttgcctcctatgagattcacaataaaaaccattatccattaagcatagatcatttcttgggagctacattgttgaagagaacagcaaacagaaggaaagagggaagtacagaaaaacaatgtcgtccagctgttaagagcacagattctggagctaaagtctctgagtccaaatccaaggtcagctggtgatctcgggcaagttatgtaaagtaacttcttagtacttcagctttcacatctgcaaattagggataatcatagctcatgcctcattcagttgttaggaggaataaatgactgttggatgtaaaaaaatatgtagaacagtgtctagcacatagtgctgaataaatgttagcaattattatgttctgctaagggcttatcatctgcaggtgctaatttgcctcttgttctgtcctagattttgaatcttggaggaaatctgagttttgattgcaagctacaaattctttacctctttatctgtcctttccataaagatattggaaaaaaaatttatttttgtcaagcacacatggcttccaattttaaaaattcaatacctagttaaaaaaaatgaaactttattaccttagatgttttctagcaacatttttaaatgctacgtcaaagttaaaggtcttggttctcttatgctttttagcagcaacctttttagcagctttattgagatataattcacacatcatacaattccctaatttaaatagtataattcagtgattttaatatattcatgaagttgtgaagtcctcaccagaatcaattttggaatatttttatcacctcaaaaagaaacttaggactctttagctttcaccttctggtcttcccaacccccagccctaagtaatcacgaatctactttctgtctctatatatctgcctattctggacatttcacataagtggaatcatataaatatagtttttttgtgactggcttctgtcatttagcatgttattttcacagttcatccatgtcgtatcatgtatctgtacttcattcctttctgttgccaaatgatattgctttatatggatataccacattttgcttatccattcatcagctgatggacatttgagtgtttgaactttttgaatccttatttactttacttagactctgttgtatccaacaaacttgaggggaagaccaaaagatgatgatgatgattaatcatatttacaaggtactcttaatgtacattttctcaaaaagcttaaaatctaagcttcatgaaacaaatagattggcaataattacccagcaaaatacagtaagtgttataactaaaggcagggatgggagttgatataataggagatgggtgtgaaaagtagacttaaagcatgatagtggagggttttaagtgcttgctgagacacttgggctttattccataaataagcactttattctgtgaaggtagtcattaaggctattgagctgagcaatgaccatgaccaattacagaggaaaggatgaatcaggacatactatatattggatgcatagacaactgttcagagcacattataattactcacaagtaataagaatgacagttggaatgggaaggaggaaatgaatgtaagatggagacatctggaggcagaataaacagatttcaatgcccggatgtgtatggtaatgggaagggaaaattaaagatgaccctattctaaatgactagatggatggaaaaccattaatggggactggaaatgtcagaagaaaaatggagcagccaggactatggaagagataataggttctacattggacatttaaaatttaaggttttggaggaataatcgtagtaaatgccactagaagtttggacatgtgggctgataattcggagaagagggagacttatttaagaaatggtttggggaattatcttcatggaagtgaaaagtgaagccaagaaagcaaaatagaagtcacactcagaaaaagtaaagagttcaaagactagagagatgagaatagaaccatgaaaaaactcattgtatctagtaaataaatagtagatgagtaattttaatgggttgaacagtttcccctcccaaattcatttctacctggaacctcagagtgtgactttatttggaagtagggtttttgcagatgtaattaagttgtgatgaggtcagactcgattagagtgggctgtaatccaacaagcagtatcccttataagacaaaggaaatttggacagagacacagacacacagaggggaagaccatgtgcagagggaggcagagactggaatgtcgcaactacaagccaaggaacacctgggattgctgggagccaccagaaactaggaagagacaaggaagggggtcttctctattgccttcagagggaatatggccctactgacacctcagtttcagacttctaaactccagaactgccagaaaataaatctcaattgttttaagccagtaagtgtgtggtaatttttcatggaagccctaggaaactaatacaggaatcaacaaaggagtggtcaaaaaggaaggccgtggaggcaacagtgtcaggaaagcccaggcatagtgaaaatctcaggaagtttacagagctcagtggtatcacgtctgcagaaagagtatattatggactggggggtggaaaacgctgcgaatttgacaacttccagatcaccactgacttgaagagatcaattttagttgccagagcaccatgtagagccctttgaatagcccatctccctcttgtgttctctgcgcttgggtcgcagtgggcttaattgtttgaaatcctcaatacactgttaagttccatagcagtagagtaatggtaaaaacatttgttttttaccaatgtttccctgttgtctagagactggaacgtagcaattgctcagtatgtgtggaaaggattgaaggatggagagaagaagtgaggaactagaaagttacgaatttagtttacacttgattttaggacatggagggggttgtttttaggaggggttataggtagagagttgagtgctaagattctctccttagaggtggagaaattagaggtaaaaataacagtttaggctgggcgcggtggctctcgcctgtaatctcagcactttgggaggctgaggcgggtggatcatttgaggtcaggagttcgagactagcctggtcaacatggtgaaaccccgtctctactaaaaatatgaaaagttagctgggtgtggtggcacgtgcctgtagtcccagttactcaggaggctgaggcaggagaatcacttgaaatcaggaggcagatgttgcagtgagctggatcacaccactgcattccagtctaggcgacagagcgagactcttgactccaaacaaacaaaaacaacaacaacaaaaatcagtttaaaagaagaaaaaaaatagtgaggtgacaaggcctaaatgagagtttgagctatattcatgtgctattgtactgtagcccacaaaccttgacacaaacttggaaaaaaaccctaagacttcaggactgaaagatgtagttttttacttattttatatttttgcctccatgtattttcttatctagtgtcagacattacgctgagagctttatgtaataatctcgttcagtcctcatgctacaaaaatgtatcattcttattttataaaaactgttaccattcttattttacagatgagaaagctaagcccagagaggttaaataattttcccaagggcattccattggtaaatagcaaagctgagattctatcaggcattctgattattgaacctacaactcttaactgcagggatggatatatacttgtagtttaatgaaaaattctgtcctattgaatttgaagtgtttcaggaaagcctttgaagatgtccttcttttttttttttttttttttttttttttttttgagacagagtctcgctctgtcgcccaggctggagtgcaggggcgcgatctctgctcactgcaagctccgcctcccgggttcatgccattctcctgcctcagcctcccaagtagctgggattacaggtgcccgccaccacgcccggctaattttttgtattttcagtagagacggggtttcaccgtgttagccaggatggtctcaatctcctgacctcgggatccgcctgcctcggcctcccaaatacactttcacatatgatcagtgcttcttaaatttttccagtctgtagatgtggtgatagggtcccaaagcagcagccttcccccacaagcataatatttttgaaatcacctcttgttttccatccaaattctatattttgctctactatgcatttttattagttttactcttataaaatagttttctaatttctatttcattacctgtactattagttaatggagagatcctgttgcatttataaaattaaaccaaaagcgtgtatcagacagttttctctaccttggtgccacaatattttgaaaacctagagttatacaaataagtaattacagatggcaaccatttttttcactgctttatcagccacatagtggtgaatcactgagaagagatattcagaatgctgctaaagcagctaaatcatatgttggttttagactactattggaaggaatttggtaagtgtgttttcttgttaacagttctcttgtatcatatcttaggctggaatggttgcttattcaatatatgatataggagacagcctcttttaactatctgaaggaaatacccaccaaagggcatttccagtgaagagagatgaccaatttggttgtgctctactttggggagtctcactatatataagctgaaccctgattctcaaaggactcgttatcactacaactagctctcttaagaccgctctcagacttcattttattgcagtgatctggaaacatacataagagtacattcacagttttatctatatttgttgattgaaaattattcagcgttgcagaaatatttgctaagtcaactttaaaccatttttcaaaaatgactaatgatttcattaatcttacatacatttttaaccctttatcatgacaccttttttgtttttaattctccatgaggaaaagccatttcaatgcaaattccaaacaccaactactatcttttttctctttagctaaatcatggtatatctgtataatataacaagctttcagagttcctttctacttcattagaaattatcttaaaagatgggtactcaaattactgaattttttctctttcttaaaacattcttttgaacacattaagaaaattcagagcttaaccttgatgtaagctacttttagtaatcgtgtattcagaatgaaagatggtcttgaagaatcaacgttttcacagtttatcctattgtagatttgactccttctacacatacaaccttacatttttttccaggcaatatctttatctctctaaagtctatataccgtgttgaaaatcttcagttattttaccattgagtataaaatataccttcataaataccatcatattaatacaatcaacatagaccaataaaataatttactaatgtttagtgctagtgctatcatctagtggtaagttaaagaacctgtctatcgagggtggagccaagatggctgaataggaacagctccagtctagagctcccagcatgagcaacacagaagatgggtgatttctgcatttccaactgaggtaccaggttcatctcactggggagtgttggaaagtgggtgcaggacagtgggtgcagcgcattgagcctgagccaaagcagggcgaggcatcgcctcacccaggaagcgcaaggggtcagggaataccctttcctagtcaaagaaaggggtgacagacggcacctggaaaatcaggtcactcccaccctaatactgtgcttttccaatggtcttagcaaacggcacaccaggagattacatcccgtacctggctcggagggtcccatacccgtggagcctcgctcattgctagcacagcagtctgagatcaaactgcaaggaggcagtgaggctgggggaggggcgcccgccattgctgaggcttgagtaggtaaacaaagtggcctggaagctcgaacttggtggagcccaccgcagctcaaggaggcctgcctgcctctgtagactccacctctgggggcagggcatagccaaacaaaaggcagccgaaacctctgcagacttaaatgtccctgtctgacagctttgaagagagtagtggttctccctgcacacagccagatatctgagaatggacagactgcctcctcaagtgtgtccctgaccccagagtagcctaactgggaggcacccccaagtggggcagactgacacctcacacggccaggtactcctctgagacaaaacttccagaggaaagatcacgcagcaacatttgctgttcaccaatatccaccgttctgcagcctccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccaaaatcaaagaccaaaggtagataaaaccacaaagatgtggaaaaaacagagcagaaaaactggaaactctaaaaatcggagcaccactcctcctccaaaggaacgcagctcctcaccagcaacagaacaaagctagatggagaatgagtttgacgagttgagagaagaaggcttcagacgatcaaactactccaagctaaaggaggaagtacgaacccatggcacagaagctaaaaaccttgcaaaaaaaattagacgaatggctaactagaataaccaatgcagagaagtccttaaaggacctgacggagctgcaaaccacagcacaagaactacatgaggaatgcacaagcctcggtagctgattcgatcaactggaagaaagggtatcagtgatggaagatcaaatgaatgaaatgaagtgagaagagaagtttagagaaaaaagaataaaaagaaatgaacaaagcctccaaaaattatgggactctgtgaaaagaccaaatctacgtctgactggtgtacctaaaagtgacggggagaatggaaccaagttggaaaacaccctgcaggatattatccaggagaacttccccaatctagcaaggcaggccaacattcaaattcaggaaatacagagaacgccacaaagatactcctcgagaagagcaactccaagacacataattgtcagattcaccaaagttgaaacaatggaaaaaatgttaagggcagccagagagaaaggtcagattactcacaaagggaaacccatcatgctaacagctgatctctcagcagaaactctacatgccagaagagagtgggggccaatattcaacattcttaaagaaaagaattttgaacccagaatttcatatccagccaaactaagcttcataagtgaaggagaaatagaatactatacagacaagcaaatgctgagagattttgtcaccaccaggcctgccctaaaagagctcctgaaggaagcactaaacatggaaaggaacaaccagtaccagccactgcaaaatcatgccaaattgtaaagaccatcgaggctaggaagaaactgcatcaactaacaagcaaaataaccagctaacatcataatgacaggatcaaattcacacataacaatattaaccttaaatgtaaatgggctaaatgctccaattaaaagaaacagactggcaaattggataaagagtcaagacccatcactgtgctgtattcaggaagcccatctcatgtgcagagacacagataggctcaaaataaagggatagaggaagatctaccaagcaaatggaaaacaaaaaaaggcaagggttgcaatcctagtctctgataaaacagactttaaaccaacaaagatcaaaggacacaaagaaggccattacataatggtaaagggatcaattcaacaagaagagctaactatcctaaatatatatgcacccaatacaggagcacccagattcataaagcaagtccttagagacctacaaagagacttagattcccacacaatagtaatgggagactttaacaccccactgtcaacattagacagatcaaccagacagaaagttaacaaggatatccaggaattgaactcagctgtgcaccaagcggacctaatagacatctacagaactctccaccccaaatcaacagaatatacattcttttcagcaccacaccacacctattccaaaattgaccacatagttggaagtaaagcacccctcagcaaatggaaaagaacagaaattataacaaactgtctctcagaccacagtgcaatcaaactagaactcaggattaagaaactcactcaaaaccactcaactacatggaaagtgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaggcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcagaaaatcaatgaatccaggagctggtcttttgaaacgatcaacaaaattgatagaccactagcaagactaataaagaagaaaagagagaagaatcaaatagactcaatgaaaaatgatgaaggggacatcaccaccgatcccacagaaatacaaactaccatcagagaatactataaacacctctacgcaaataaactagaaaatctagaagaaatggataaattcctcgacacatacaccctcccaagactaaaccaggaagaagttgaatctctgaatagaccaataacaggctctgaaattgaggcaataattaatagcttagcaaccaaaaagagtccaggaccagatggattcacagccgaattctaccagaggtacaaggaggagctggtaccattccttctgaaactattccaatcaatagaaaaacagaggatcctccctaactcattttatgaggccagcatcatcctgataccaaagcctggcagagacacaaccaaaagagagaattttagaccaatatccctgatgaacattgatgcaaaaatcctcaataaaatactggcaaaccgtatccagcagcacatcaaaaagcttatccaccatgatcaagtgggcttcatccctgggatgcaaggctggttcaacatacgcaaatcaataaatgtaatccagcatataaacagtaccaatgacaaaaaccatatgattatctcaatagatgcagaaaaggcctttgacaaaattcaacaacccttcacgccaaaaactctcaataaattaggtattgatgggacgtatctcaaaataataagagctatctatgacaaacccacagccaatatcatactgaatgggcaaaaactggaagcactctgtttgaaaactggcacaagacagggatgccctctctcaccactcctattcaacataatgttggaagttctggccagggcaatcaggcaggagaaggaaataaagggtattcaattaggaaaagaggaagtcaaattgtccctgtttgcaggcgacatgattgtatatctagaaaaccccattatctcagcccaaaatctccttaagctgataggcaacttcagcaaagtctcacgatacaaaatcactgtgcaaaaatcacaagcattcttatacaccaataacagacaaacagccaaatcatgagtgagctcccattcacaattgcttcaaagagaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaacaacaaagctggaggtatcacgctacctgacttcaaactatactacaaggctacagtaaccaaaacagcatggtactggttccaaaatagagatacagaccaatggaacagaacagaaccctcagaaataatgcagcagcgtacctacaaccatctgatctttgacaaacctgacaaaaacaagcaatggggaaaggattccctatttaataaatggtgctgggaaaactggctagccatatgtagaaagctgaaactcaatcccttccttacaccttatacaaaaattaattcaagatggattaaagacttacatgttagacctaaaaccataaaaacccagaagaaaacctaggcaataccattcaggacataggcatgggcaaggacttcatgtctaaaacaccaaaagcaatggcaacaaaagccaaaattgacaaatgggatctaattaaactaaagagcttctgcacaacaaaagaaactaccatcagagtgaacaggcaacctacaaaatgggagacaatttttgcaatctactcatctgacaaagggctaatatccagaatctacaaagaactcagacaaatttacaagaaaaaaaacccatcaaaaagtgggtgaaggatatgaacagacgcttctcgaaagaagacatttatgcagccaaaagacacatgaaaaaatgctcatcatcactggccatcagagaaatgcaaatcaaaaccacagtgagataccatctcacaccagctagaatggtgatcattaaaaagtcaggaaacaaacaggtgctggagaggatgtggagaaataggaacacttttacactgttggtgggactgtaaactagttcaaccattgtggaagtcaatgtggcgattcctcagggatctagaactagaaataccatttgacccagccatcccgttactgggtatatacccaaaggattataaatcatgctgctataaagacacatgcacacgtatatttattgcggcactattcacaatagcaaagacttggaaccaacccagatgtccaacaatgatagactggattaagaaaatgtggcacgtatacaccatggaatactatgcagccataaaaaatgatgagttcatgtcctttgtagggacatggatgaagctggaaaccatcattctcagcaaactgtctcaagaacaaaaaaccaaacactgcatattctcactcataggtgggaattgaacaatgagaatacatggacacaggaaggggaacatcacacaccggggcctgttgtggggtggggggaagggggagggatagcattaggagatacacccaatgttaaatgacgagttaatgggtgcagcacaccaacatggcacatgtatacatatgtaactaacctgcacaatgtgcacatgtaccctaaaacttaaagtataataaaaaaaaaagaacctatcagttttttcaagtatgtattttgaatacattaaaatatatcatttgatagcatgtaataggcatggccctttttgttttagcttttaggctgcctctttttacttttttctttttttgattcaatacaaatttggccttttctaagttatgtggatttagtttgatcaaaattacttctgtcatataaactccaccttccaaaaagtgatttgtaaactgatcttgaagaacttcaagtaatttttttggaagtttcttgttctatatgtgtcctattttattcttcaaactgagacttctatcattcagtcaattttagttgaaaaaaattctgatgatttccctaaaaaaatttttctattatgaaaaatttcaaataaataatctccctttatccatggtttcactttctgtggtttcactttccacagtttcatttacccataggtgagtacagtacaataagatattttgagagagagagaccatattaacataacttttattacagtgtatattaatcttttgctgagcataatttataaattaaactttatcataggtatgcatgtatagaaaagaacatatatagtgtgtatatatacagagagagttcaatactatctgcagtttgagtcatccactgggggtcttggaatgtatccctcatggataaggaaggactactctatatagaagtagagagattagtgtaattagtgtaataaactctgagtctaacccatctttagtaattatcagtatcttgtcctagttacatctgttctccactttttgttgatgttgttattgtttttctggaatattttaaaagaagtctcagctatatcattttatccatattatcagagccaacaaaaaattaacaataattccttaatatcatattatactctatctatatttttcccctattgtctcacaaatctgtgtttagatttggtttgtttgaataaggatcccgctgaggtccacacattatattagttgatatgtttcttaagtctcttttaatcagtaagagtccccttttatcccccttatgccgtttacttattgaagaaattggattatttggcctgtaaattttcccactttctggattgtggcccactctgtctttataatatcgtttaacatgtttatctattcccccatatcttctgtaatctagtcatcttatagagcttgattagatttgaactggattttttggaaagaatacttctcaggtgacagaataatattattcctattgtatcacaacaggaggcaagagatgtctgcttatttcacttttagcaatgttaaaattgatcaggtagtattagtctggcccatcattataaattcccccatgaatattttacatgtggttttagcatccattgatgtgtactatggtttgtcagcaatttccccaactcacaggatttaaatttagtcatttaaattcctccactaggaaggaggaggcatcctgccgttattgagcaagttctgtgcgccagaaattctgcttaacagtttacctacattctgtgctttgctcttcccaaatcttgcgcattccatacatcatagtagtttaataggaaaggaaactgcgaatagagagattaatctgttcaagatcatgtagctagtaagtgagcccagttctgcaggtttggagggttgttttatgaaaaattaacctggaaaatattaattctcatttatatgtagaagtgagtaaactagattaaaagtaaagaccaaactgaatggaatcaacaacatctgtagcatttgtactgccatcaataaagcaatgctaatgttatacatgcttagtacttcccttgccccaattctggaccattggagcctagcaaataatttatttcagtgataaatatccctttaatggaccaaaaatgtaagatgtatgtattttaaggaacaccatgacgtccaccaaataacatttttataaaatgaaaaactgtatcacaaagcattttctataagtctttaaacatcatttgttttcaaggtttggatttagtcttgttcagagcagcaagctgatgtctatatgacctcccaaagtcctttccagtcctgtgattctcacactaatgaattgaaacagaaaaggattattgggccagaacttggagagtcttcagagccagaatgtagaaaaagttacaaaatacagatgtctgtcagggatgggatccaaagagaaaagcaggccagaagttagaaatagatatgttattgtacaaaaaaaaaaaaaagttttaattttggcttttaaccagaataatttttttaaatattcagataaagctattaagctataatatccagttgagagacagtgaagtcctgtgattaaggatatataggtgaaaaaattcataattctttacattcaagtgaatacagaccagctgttggttcttcagacctgtgccagattgtaccttttagagaatctataatcttatatttttcattcagaagtaaaatcattctgatgccctttggaattgtcagtgttgcatatcaagaattataaatagaaataaaaacctttaaaatattgtataattatgtgagatatggcaaaaatgtttatactttttaacccaaaaagtaagccattatttttattgttttgttgtttattgttctattgaggaaaaagcctcttaaattaatgccattcattttaattgcatactaaacttgggagaatttgttatattagggagattttgttctttctgaggttttttgttttgttttaacttttcaaagggtatcttgttccaagaatacttttttttttctcttgggcggcagggtcaggagaagaggatcagagtaggcaacaactgagaaggttcctgattgactattctgtgtggatgtaagacctagtctatgggcaccactggttgttggatctgtgttgttgtcgtttatccatccatacaattttttagttttctgttttacatctttatttttgtaaactttcatgaatctcaagagaaaaatttgccacctataacctgtaatgtatcccctaaatagctaattaggtgtctatggcttttattctaccctataatgtgttatgaatttaactaaattgtctaaaaagcactccccaaactcatcttttccacattacattctttctacctgatgatccacgtaacaggacacaggttaccaccaaataatagtggtcagtgcagccagaaattctatctgcaaattcctgaattaagagccagtctttctagcccaggaaatttgcctctctgtagattttctaagggttgattttgcaagacttagaaaattatagattctttgagaggcttctttgttcccttagccacctgaaacctaaaaacaactaaatgaacagatgtatggtttgatatgttcagttgatatgtaaatagacatatttttgaaaatcctgtggctgctcttatgggaaatcaggtatgtataaggttaagagtgattggtgctaaactattatatgtcattatttcaagcaaatttgacatgacagacagtaggaaagaagaacatgatcaatgtcaaagacattcatgtttccttgtaatggtatatgtcacatatgtgcttgactccttttttttgcattctactttgtggagacagtgttgaagtggtcatttaagaatatgactgtgtttgcaaactatatactcaggagtatatagtctctctattcgcagtttcctttcctattaaactattatgatgtatggaatgcgcaagatttgggaagagcaaagcacagaatgtaggtaaactgttaagcagaatttctggcacacagaacttgctcaataacggcaggatgcctcctccttcctagtggaggaatttaaatgactgaatttaaattctgtgggttggggaaattgctgacaaactatatactcaggagtatatagtttactatataaacatgagtatattcatgtttatcagatttaaacaaatattttgaaattccgagtagttagaaaaatttatttttaattttttgggtacatagtagatgtatatatttatgaggtaaatgagatattttgatacagtcatacaatgcataataatcacaacagggtaaatgcaataaccatcacctcaagcatttatcatttctttctgttataaacattccaattatattattttagttatttttaaatgcacagtaaattattgttcactgtagtcaccctgttgttctatcagacactagatctttttcattctaactgtatttttgtatcccttaaccatacccacctcccttcccctgccccaatactcttcctagcctctggtaaccttccttctattctttatctccatgagttcaatcatttcaatttttagctcccacaaatgagtgagagcatgcagagtttgtttttctgtgcctggcttatttcatttaacgtaatgtcctccggttccatctatgttgtggtaaatgacaggatttcattcttttttatggctgagtagtactccattgtgtgtatgtaccacattttctttatctgttcatctgttgatggacacttgggttgcttccaaatcttggctattgtaaatagtgctgcaataaacattagagtacagatatcttttaaatatatgatttcctttctttttgttatatacctagcagtagcattgctggatcatatgatagttctatttttagttttgtgaggaccctccatactgttctccatagtagttgtactaatttatattcccaccgacagtgtacatgggttcccttttccccacaccctcaccagcatttattattgcctgtcttttggataaatccaagtagttttatgtgtcatgaacaaaacgtattatacacataatgaaaattaagttttctgatttttaagtttatatgcaaatacatcttaacatcttatctattttttaaaaagagacttcacaatggtttgcaataattacatttttatttcctgtcagtggatttatgtgtgtttgaaatggtttatattttatatgcatttagttttaattgaatggtatatattttatattcattcgtgatgaagtatttctaaggtagaaaagaccttaagttgaactctgaaatagcaaacacattgtggacatttgtgaatttatgttacttttatatgtttatttcttgacccttcctccagaaagccttcccctgatgtcccctgtctccaaccaggtggaaaagttgccccactttgggacacttatattaccctttcctgggcccatttatattacttccttccactttgctcttcttgagaacagagtttatataatatttatctttgatctccagtgcctaacatagtacttagtgagtgttgactacgacttcatgaaagcttaaaatgaaatagaagaagattatcttaatgtactgaaaatgtaaagcccatagtctgggctttacgtgagcaggctgaagagcaggagacctttgtagcacttctggagagggttttgaacaaagacatagaagctgagattagtgcttattctacacaaggcaccattgtggagagacaggcagttagaggggcacataagttagagttctctgtgcacagatatgcacagataacaacattagatagtattattaagtgccgtaagagtttaaaccatacatggggtgttttgggaattcagaaattacttctaatttggatgattggggagggctgtttgtttttgtttttcttttttgtcagaggtgtagtgagtagttttgaaagatggatgagatttcaagaaactgaatggagacaaactgatgacagctaaaggtctatgtagtgtgaagtggtacattagtttgggcagagagttaggggccagaattggggcctaattccttaggaatgttgatggaatttgcacacaattgtgttttgaccacactgagatttattcccctaggacatttatccagaataccagaggtcaactaagataactattttcaaaactacactgtatagtctgccccttacttaggagctaattatgcaggcttattatttttttttagcttttcatgctttttattctttctccttcctgttatctgcctataaataatttttattttgatcagcacctccatcagagtcaaaatcatgagtgtcttgcctacttttcatcagctctacagtatgaaattacagacttattatatgagaagaagatctcttccactgatagttaaattaattcatttaatttaatttggactgtaaagacatattcaaatctaccagaaaagtatggaatgagtacattggtaaagaaaatgcttatatttttaaaacacacttcaaatcacttctagtaatcccaggtacttgactatttattacgtttgtaagttctatgaagtcacgaatcatgtctgtctgcctcgctgatcgttgtatccctagtttacacttatcatggaaacatttaatgaatatttgataaatatattaagtatacttgataggctaattaaaacacatttttaaacatacatttctatatgtatgtaatatatgtgttacatataaaatcactttcaataaagtacagacattgtcaagaattgtgaaaagttagagtttgaccttatttgcaagtctcatggatagaaaacatgagaatgctggatcagagatgaaacatagttctttacctacaacagagtgtctgcagatatgctagttccaaaccctaagtctctgaggatgacatgaagaggaccagctgatgtctgcacacacagggagttgtattatagtagaggactctgatttggaggacctgaatcttttataatggacagtaagcctgcctgcccttttctttctagggagacaactatctgtcttcgttgactgtttatcatatatttatccttgaaaaaacagtctggactgggtttgtggcatgcgcctgtaatcccactcaggagactgagagaggaggatcgcttgagcctaggagttcaaggccagcctgggcaaacatagcaagactccatctctaaaaaaaaaaagtacattttaaattttaagaaaagaaaagatagtctggggaaaaggcaggcaatgcctttacctataagatatgtgaaaatgtgctagacccatggagaactattccctagtagacatataccctaaagggcctctgtaagggcattgcttttcatctaatcaagggatcagcagcaaactacagcctgtgggccaaatctagcccaccacctgtttttgtaaataaaattttattggaacatagacacatatgctcatttacatattgcttatatactacaatagtcagagtcaagtagttgtagagtcaagtagttgcaacagagaccacgtggcaaacaaagcctaaagcatttgttctatagccctttacaggcaaagtttactgaccctagatctagcctaaatatttgacatatgaggaagctttgtaaaatatgctaagttgacttttttctaaaatatttaaaaattttaagttattctctaatccttattgacttcttcacagttactgagagttgcctatctgtactatagttttcacattatcaagagttattaagaacctattatctacctctgaatgtaaaacttgaaaataaattttgaaagaaccaactatcaatgattacacctttttagctttaaaacaatcatgtaacaagttgtcacagtgtaagtgtttggtttatgagcattgcttatttgtcagtttatatttttgaaaaccatgaccgtcaagtaactgaaatacgggagtcagtatgacaaggtgaaaaagcttcctgggctctggaatctccaggagtcccggctttgcaactaattatcattgagatccttgacaggtttttttaactttctgaactttattttcttgatctgtaaaatggatatactcttactaacttacagaattaccattaaaattgaataatgtaaatcttcacatgtagtatgcattttaaaatattagttcttttcctaaaatataaacttaaaaaagtaaatcttatgtatttcttcagagttggaaagaactaaagtagttcttattctatcttcctaaatttttgtgggtaaggaaactaaggcttacgttggttaggtgactttaactcaagatgacaaaactagttagcaagtaaatgtagaattaagctctccctgattcccaagtattgttatttatagtaaatgatgtacatttgactgcatttgatacaaataagtaaaatatctgaacagttagaaatgagactaaaacataatatgagtttagagtttgtagtctcattaaaagacaccataaactagtaaagttgcccctgctctaagttttaactcagaagttctgagtatatttttattctttctctttaaggaaaaatattttcttgaaagatgtcatattacacacctgcatttgcttgaaacctggtagcttgataaatcgataagataactgggtcatatgttaagttttttgaaaaaccaacccaaacatagattctaataaaagaacgttacacatttccttttaaagtctaaaaagtatttctcagggctcttaaattaccatattctgataccaggggaaaataaaatctggacttagagtcttgtttgtacttagagggttttccggacaggaaggcagtcttgatgcaatgcagtaagccacaataccagtggggcattacaggtgaaaaatctgcagctgtaccccttcaccacagtgtattacaactgtatgctggaatatttcctgtacaaaaatagggtttggttaactttgtttcccaagagtagatcacattaaaatgttataaaatcatgatttcctgcatttgaatacttgtggtttctcaactggttccaatagtataagggtttttttttttttttttttggtatgacttctattagttgaagatgtatagaagcttttcttttccttcttcaaaatcaactaaaaagcagatacatataaaaagaaataatattataagctaaaacttttgagattgcaagcacattcatcttttatctcattggtagattttttaaatgatatagaaactcaaaatccaacttccattaccagaatacattttatttttatttagtaactattgaaaagtatctctactcaatttgcatttgttttgagtgatgaatatgtgtctcctactgtaaattataaataactgattgtaagaaatactctttatgtttaaaaggacagttaagccctaacacattcataaagagaaacctcccattattgtacaaagacaaagccggtttcttagcctattaaggttttgatgttcataatgctgtccatttatccctatctctagataaggactgtctctttcagtcactgaacatgtctatttcatgcccagacctcactttctattttttaactatctacttactctcctccagccatcagtttaaaactctttcacctatgtacttgtctactaattttctagtacttttctctttggggaatatatttggttttatcaccatcttaacattgtataagtgcagtatatacttttactttgttaatgacataaaatagcattctataattgaaataatagtttcacaacaattactctttcaaaagttactaattaggagctttcaggggcaaaaggcctcccccaacccccatgcccccactccctgccacaacacctagggttgtatgtcaaaaataattagaggcaattgattagttttaaagttgcttgaggcagtgggaaccagttggggtaaacaataggctaaccaaaatgtttgaaaggaaaaacgggaatgagatgtccatggggttttgaaaagctccaacatattcctgggaaactacaagtacatgctcatgaataagactatgcacacccccagggatgtgtgcctgctcagggaagacctgagaaggtcctgtactctcacctctgtctgtccttaaagctctgtgcaagcagtaagtgaaggctaaggaggagttgaaggtgtgcgccagagctcaaagagcccttcagccaagaattggaggcttattggttccagacctttagggaagtctgtttaatcattagctgactactacactaaccaagtggagacttcactaaccaactggagacttcactaatcaattggagacttcagtggccacacaatgaaaattacaaacttcacaaaattagctcataaatattactaaacaacaactacaatgtatagcaaggataataaaccctgaggaggctggaggcggtggctgatgcctataatcccagcactttgggaggccgaggtgggcagatcacctgaggtcaggagttcaacaccagcctggccaacatggtgaaaccccatctctactaaaaatacaaaaattagttgggtgtggtggtgcatgcctgtaatcccagctactcaggaggctgaggcaggagaattgcttgagccaggaggcagaggttgcagtgagccaagatcgtgccactgccctgcagcctgggcaacagagggagactccatctcaaaaataaataaataaataaataaacaaataagcaaaccctggggaagaggaaggatctgatttttaaagttccctttgtttatttacaataatatagttaataatgttatttattaatattataaaatcttatatcattaaaaatgccattttcaagaaagtagtatgagatgggcaaagaaataagaaagtacagcctgtatatgttaaaaaagcgatcaatagaaattgtccctgaggaagcccagatgttggacttattagacaaatacttgaaatcacctgttttaaatgtattcaaagaactaaaaaaggccatgtctaaaaagcttaagtataggaatcatgtctcaccaaatatagaatattaataatgagattgaaacaataatgtttaaaaacaagtacaaattccagaattgaaaagtgtaataactgaaatgaaaaattcactagaggggctaagcaacaaatttaagcaggaagaagaatgaatcagtgagcttgaagttaggttgttttgagattattgagtctgaagaacagaaaattttaaaaaatgaagaaaaatggacagagcttcagagatctgtgacacaccatcaagtgtaccaatatatgcataggggaagtcccaggagaggagagaaacgggaagaaagaatatttgaagaataatgggcaaacacttcccaaatttgatgacaaacatttatctacatctaagaagctcaatgaactctaccttaaataaactcaaagatatccacacttagacacaaactgtcaaaagacaaagaatattgaaagcaacaaaagagaagtaactcatcacatataagggatattctaagattaacagctgatttctcatcaaaagccatagagaccagaagacagtgagatgacatattcaaagtgctgaaataaaaagactactaatgagaaaaagcctgccaaatgaagtaactataaatgactgggataagtggcaaaaatgaaaatgtattctccgtttattgcttcctaagaacccactttaaagaaagtggaactggaaattgtaaatggcacattatggggtctatcttatttaatctaaaaattattaaagagcataggatttacaaccagaaagtttgccacttactaaatgtgtaatcttgagcaggttacttaacttcactgagccatatttcactcatttataacatgggaataatattttcctccctgaaataatgtgtaagaaaaatctgtaaatttgtatcttgtagagggctattcaaagggtagtttcttctaccacagctgccatcactacctgctactatcaaaacaccgatgatggtagatatatagctgttcttctgctataattacccaatttggcaccctgggaagtctagaaatatggcgggaaaagtgatgaagagagtatcctctgctgtaaccaaactctaataactaagtctagaatggaagctctggctttgtactcactaaccagacttacaccgtcagctaccctgttttgtcatagttgagcagacctgataggctacatcagttgctagatctcccctctctacctaccaactctttattaggctacatcagttgctagatctcccctctctacctaccaactctttattatgcacatatatacagcaaagacacttcctttgttgttttgcctaggttgcttagttggactgagtggagaaaggggtaatggcccagcttcagcagcccctgcgcaaagaaatccatgaggacagatgggcagtcataaccctgctaacagtcttggcagtactattaagtaataaaaacaaattaagtgccaaaatattctttgtaccaaaaatatttttaaatggccaacacacatgcaaatcttcccaaattagccatcaaatggaaacaaattgtggaataacattttaaatgcaaaaatacatgtgctcttaccaactggcagatatacaacctaagatattcatatgcaaagactacatatgcttagagtacagtttattatgtatggctggctaattttttaggtcctgtcaaataatggataggaaaacaaaatgtaataaaaaaatatataatcctgacagtcatttgaaatgtaccatgtgttacatgtggaatgttttccagtgaaaccaatttacttgttcccacttcccatgactcagtactagatattcgggctttctaaactatttttttggcaccaaactcttggaatagtcatctttccttcaagttattcagtacaggcattaataacaaatccttagttatagatattgtaactaaagatcattcacgtcatctctttcaaaactaaaagcacataataaagttattttaaatagatcacacaaaatagagcccagagttattccttgagaataattaattgctaccatatgaagttataagaacaataagaccacattaggtttttagcttaattatgtcaccaccaactagagattagttgggcaatgtcaacttctaactgaaagacaagagaggattagtgagttaagttaatgcaaagtttgttaaaaattggcatgaatgcaaaataatttgagtggaagtaccagtatattaaacaagatctttttagaataaaagactgctaaagaaggtagcatggttatttttaagaatactagtctgagaacgtagaataaaagactgttaaaggaggtagcattgttatctttaagaatactaatctgagaacacatggcatgcaagccaggcctcaagaagtagtagtaggttacctttagaaccacagccattgtctctactcctcctaaatcaggtgtcagttccaccacatgcttcacttccttgttttctagtcaccacccaaactataagatgcatttcttcctgtctagatactgtacctactcttaccaacctccctcttcctcagccttccatgcccttccactttgccctctggatcatcttctccttgattaatgaactctcccctaaacctccacctgttcttccagaagttcttctgtgccattactttgaataaaattttgctgtcccctgggacctagttcaccattgcgaccctctgatgtggaggctctcacgttctttttgtctcaaggccaggaggataagtgttctccttgctcaccagtgccactggcctttactcttcaaccctcttgtcaagtccccttgcttctcattttctctaattatattctcctcatccctctttgttgttgccatctactaactttttggtcattctctcccattctcacaagtccttaccccatggctgccaacctttttcttcactgccataaattacccagccaaaaccctacgttgatctcatatctctaggaatcttttccactccatttaactactcactcccatgcacaagccctggatcttgtcatcatccacaactgctgtgactcctaaatcattattccagcatcttaagctccctcacagtctttcatagctctctgtcctgcttattcaaaaacccccactacagttattcattaaactattcattaaactgtagttctctgatgtcctcttttcatcagctcaccattttcatatcctcttttaaccagtttgcattcttagttcatcatttaaaataccttcttacaaataagtaacctaaacttcattgccctctgtttttccactatacactcctgacaaaaggctagtgctgaatgaactgtagctgtgtatcagcacagttaactccctcttccagtctccagaattgccaaccccttattcagtatttttgctgggatggctcattggtacctgcagctcagaatggccaaaaatgaacttctgatctctcctcctctacccacatatactacgtatcagtcttacccatcccagtaaatgacatcagcatccatatggctgctcaggctaggaaactgggagttattcttggcacttccctctcacttctcagccaatcaatcaataagacttattaattagtatgtcccaagaatctcttacatactactctgttgccaccaaccatactctcagctatcaacatttctagcttagacctcctaattggtcttattgcatccacgcttgtctctttttttctttttcttttcttttctttttttgtattattgttattatttttgagacagagtctcactctgtcacccaggctggagtgcagtggcatgatctcggctcacttcaacctccgcctcccaggttcaagtgattctcctgcctcagcctcccaagtaggtgggattataggcgcccaccaccacacctggctatttttttattattattatttttagtagagacggggtttcatcatcttggtgaggctggtctcgaacttgtgaccctgtgatccacttgcctcagcctcccaaagtgctgggattacaggcatgagccactatgcccggccacttgcctctttttattccgttgtctatagtatccaaaatctttgaaaaatacaaatttgacatcacttctttgctttcagcccttcaaagaaaataaagtcaaaaatccttaatttggcctaaaaacaatacaggttttattatccttgtttacaagtgagggaactgaggctcagaatcattaaataggttgcccaaggtcatagagcagtgatttaagtggtagggccaggattttatccgaagtgtgacaccaatgacttttttttttgtaggatggagaaataagataatgtaaagatgatgtctacatgcttttaaaagtaaatttatggttcaatatgtatttgaataaaatctttaaaatattgtactcagtgttgtttttaggttttatttcgatgtgttaaggacaaatagagttagccttttgtatccatcagttctacctccatggattcagccaaccaccaatcaaaaatattcaagaaaagaaaattgtgcttctactgcacatttacagacttttcttgtcattatttcctaaacaatacagtgtaacaactatttacatagtatttacattgtattaggtatcatgaggaatctggagatgatttaaagtatatgggaggatgtgcataggttatatgcaaatactgcagcattttatatcagggacttgagcatccatagattttggtatctgtaggtagtcccagaaccaacccctcatggatactgaaggatgattatatattcttataatgggaaaaaagaataagtacgtgacttttatacatgtatttaaaggcatacaacttaaatttttaataggggtttcatttggtgtgaatttattaatatgcctttgttaacagagtaaaatagggcacataaaggaaaattctgacgcataactgacatactttggtatgtatctccatagtaatctattgttttctgaattttcagagtagctgagaatattccagctgaagtatgtaactacagagccagcctcacacaagttgtgaactaaataaagtttttctttggcattcttccacatctcttactttaggctcccagaattcctccttccctaaaccccactgttggtgcagtccacattcattgcccctaggctacctaatggcttcccacagcagttcccatcttggactgccttatattatgtacctactccaaccctcgccttgtacttaaaaacttagtggtgctttttccttaaggtcctactctgccttccaatgtgccagctaatttttataagctattatatattaattttaatgcagaatttcaggagatgatgctggaaacaagtattttttgcatattttctgtataccctctccaccaaaaagattacattgaactttatattccgttatttgtattaccaaaaacaataggtatattaatatgctttttcttttgggtggatgataggcaattttatattctttgttgtacttgtgtttatgcaacattttataataaacacattctttaattttttatttttagttagtatgggtacataatcatatatatttatggtatgggacacgtaatgttttgatacagacataggataaataagatctgatatttgatagcacagcaaggtgactatatcattaaattattaatatgctttttctcaactcatttgcccttcccttgtccactgagtttttgtttgtttgcttgtggttttttttttatttttttgaaacagggtctccatctgttgtccgggctgggtgcagtggcacaatcatggctcactgcggcctcaacctcctgggttcaggcgatcctccgacttcagcctcctaagtaactgggaccacaagaacatgccatcatgcccagctaattttttttcctcctgtagagacagggtcttaccgagttgcccaggctgatttcaaactcctgggctccagcaatcctcctgtctccacttcccaaagtgctgggattataggaattaaccactgtgactggcctccactgagatttttatatgtctctctagggatttatactccagttaccatatctcttccaccgctggttgttatgagtgtcttaaaccacagggctgacccactggcagtccagagagtagttaagcaatgatatattcctttatctctgaagtcatagcatatatggagggccacacttttaacaggtatgtagcagaaaataatattgaactgtgggtacagtgttcctgaacatccagattcatagtttattattttcttccaagaagtccaacccattattaagaaatctaataatcagaactcttacaacttacctgattctggcaacaacatataagcttccaaagtgttctttgagcatgagaggggtaaataatggctaacatttcttaagctcttactatgtgatattaaataaaatgctttgtctcatttaatatttatgaaaattcatgagggtagctatattcttatcccccttttacacatatgggaacttgtgttagaaaaattaatttaatttaggcctggcacagtgggtcacacctacaatcccagcactttgagaggccaaggtaggaggattgcttgagcccaggagttcgaaactagcctgggcaacagagggagaccgtgtctctataaaaaatacaaaaattagtcaggcatggtggcacgtgcctgtggtcccagctacttggggctgaagtgggaggatcgcttgagccagggatatcaaggcttcagtgagctgtgatcacaccacttcaccctagcttgggcaacagagtgagaccttgtctcaaaaaaaaaaaaaaaaaaaaaaaaaaaaaagaagagaaaaattaatttgcccaagaaaaagttaatggagctaggatttgaatcccgatagatctgatccaaagttcatactttcaacttctatacttctttgtggagaatctttaatgtgccagagatgggttgaaccacccagaatgtgtatattcattcattgattcatgaattattcattcatttattcagcaactctttttgaacatttgctgtattcactatcccaggtgctgtgaaaattcaaagcttagccaaatagaaatcattccctcaaggaatgtgtccaccagagaagatgtcacatacagaaataactataacatgaagtatatagtgataagagctgtaaaagacattcccattttaaaaaaattatttgtgttcagaaaagagaaaggatttttccatctggggaggtgaaaaggctgagataggtggtattctatttggttatggattgatgtgaaggatttagacctgagacagtgagaaagtagggggtatagaggtatttcaggctgagagagaatataggagcaataacccagagaaaagaagttagagaaaattatgtcatggaaagcaagaaaagagagaatttcaagaaatggtggctaaaagtttaatgccatggatatgtcacttatcactaaccagaatatgtgctactatttcatcacatttaccctcttccgcatatccattctcccctcgtccttacagcatctcatcatatatggatgctcaagtcactgtttaaagaaaagaaacttaattataggtggaggtaacgtttatttcaacatttagtcctgttgaaagattgagaattacttatttaggaaagaaaggttagggagcaatctgttcattaaagaagcttttttgagatcccattttgtcctcaaaactgtgttaggtgctagtaatatttttttaaataatgtgccatttctgccctcaaggatcttagagtcaactaaaggagacaaacatataaataagtaattacaaaatatagtgagtcctgtgttagagtagtgtactaggtatagacatgacacaagagaggcagtgatcagttctgaggatggtaattagggaatgcttccaaaaagggaaacacatctgagccactcttttattttttaagacacataggattaacccacatgttctcatcctaaacaaaataatatttcctagatgtctttttgtgttaatatagagagagattcttttttttttttttttttttttgagatggagtctccctctgttgcccaggctggagtgcagtggcgcgatcttggctcatggcaacctccacctcctgggtttaagcaattctcctgtctcagcctcctgaatagctgggactacaggcacctgccaccacgcttggctaatttttgtgtttttagtagatacggggtttctcaccttgttgatcaggctggtcttgaactcctgacctcaggtgatccacccccttggcctcccaaagtgctgggatttcagacgtgagccaccacacctggcatagagatatactttattcattttaacagttgtgtagaaatacatcctatagatctgcatgttacatgtaaccaatcctctattgatgatattcgacttgtttcaacttttcttattaataaacacagtactgaagtacatacacacacatatgtatatacatatatatgtgtgcacacacacttgtgctttggaatctctgtaaaacaaattcttagaagcatacttcctaggggaaaaaaaaagttttggctaggcgcggtggctcatgcttgtaatcccagcagtttgggaggctgaagcaggtggatcacctgaggtcaggagttcgagaccagcctggccaacatggcgaaaccccttctctactaaaaatacaaaaattagctgggcgtgatggtgcatgcctgtaatcccagctactcgggaagctgaggtgggagaattgcttgaacccaggggccaaggttgcagtgagctgagatcgtaccacttcactccagcctgggtgaaaaagcaaaactctgtctataaaagaaaagttgtttttttctcatgcttgtacagtactcagaccgatcagtcttcttaaactgaaaggttagtaaataaaatattacattattgctttaatttgaatctctttgagtattggtgaagttgagtatctttttatctttttgtgtttactggctggttatattttttcttctgtgatctaactgctgtcaggatctgggattttacccagtgcaagctagtaagttatcttgttagtgtttcatgggtgctggcagaaggaataagactcctggtcagaagcaaagaagtctattgcttgtggcatggcaagcagcatgagcatcatgttttcattggttccccttgttcccaagtcccacaagcgtgatgcagaagtgcccccagggggatgctctgcttgcagtagacatttggcacagttgaggaacttgtaaaatctaccttttctctgtgattatgtatcattttctcattgatttgtaagagctctctcctatcagaatgaatattccttcacctgtcatcaaatgttacctgtcttattccagtttactttttaaaatttgattttatcatgggtttcatgccatacatacaaaagtctaccctattataacattttaaaaatattaacatgtttcttctcttacactttcacttcttagccttcagcagttttatccttttggagtttacttttgtgtaaagaatgatgtagggacccactttggttttaccaagtgactagttagttcttgcagcttcattttccgtctttctcctacttatttggtgtggcaccttcattactttttttttttttttttttttttttttgaggcagattcttgctctgtcgcccaggctggagtgcagtcactggtgtgaccgctgctcactgcaatctctgcctcctgggttcaagtagttcccctgcctcagcctcccgagtagctgggattacaggtgcacgccaccacacctggctaactaatttttgtatttttagtggagatggggtttcaccacgttggccaggctggtctcaaactcctgacctcaggtgatctgcccgcctcggcctcccaaagtgccgggattacaggcacaagccaccatgcctggctggcaccttcattgcatagtaagattttgtctgtacttagccctttctctgctattttattcttttaatctatttgtatgttactacactagccttatcttttacttactatgggtttataatacatttaacaccttgtagaatttgttctccattattacttttaaaattttggctgtttttatatattattcttgaattggtctttaaaaataaacaggatgaatatacaataatatgaaaagaaatcctaaactactgtcttttataaccttattctcctctaaaggtcttaatgttataatttttataaaggtttaatttgaatttcaacaaatataaaagcatagtttctatttgcaacttctaaattttttttattttaacataggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaaggtaattcattgaaagatgatatggtagcattacactgggaaacaatgataagtcatcttttcctatctagtgacccctcacttaactgtatctcagctgtctagcagctgcatctctctgaacaacagatgagaaccacaaagaaagacaaaatctgatgtttcaaagtctgcatactcaaaatcctgtgtttttactcataatacagctctgtgagccctcactaagaacctgttccttaaatataaaaagaaaaaaatggaaaaaagcaagttaaacaaaaagtctagtcatcttcaacctcaaaatacagaggcatacagtcatacacacacctcaatagaagcttaatgacatcataatcaatatgtgtaatgattatcctggggcattaaaagaaatgttaaaaaaaaattgaattgtctccttctaaaaggtaaattttaggaatattttcatcttaattgtttttttaaaactttaaaagacaagcctcccctaggtgacaaagtgcaactctctcaaaaaaaaaaaaaaaaaaaaaaaaaggcgacagtcctccagacactaagaaacttgtgtagctaaccaaaataactcatacccaatggattttatacagataaagttttatccacctataaagcctcactggccataaagaatccctagagctggccgggcacagtggctcgcagttgtaatcccagcactttggaaggctaaggcgggtagactgcttgagcccatgagtttgagatcagcctgggcaatgtggtgaaaccccatctctataaaaaatacaaaactagctgagcatggtggcacacacctgtagttccagctacttgggaagctgttggggagaggatcccttgagccccggagggtgaggttgcagtgagccgtgatctcaccactgcactccagcctgggtgacaaagcaagaccctgtcacacacaccaaaaaaaatctctagaccagattatcctcatttcagtttttgcctacttaacacatccactaatttacagtagagaaaaatagcttcagcaatctattcttcagcacttctagcttacacacatttgctaagtccctttgctcatgcccccataaaagacgataaacaaagtaaaccacaaccagtggaacagctttcttgggtcatatactatcatgtgtactgtgaggctatgctgttcattgctgtggatgccctacgtgccacttctcctgatgggctggcttagtgttgttatcttattccttttatgtaataccttcttctttccctggaaacaacattctgacagtaacagaaaaaaaaccatccaccattccaataccttgcaaatcaaatgttttttcttttctctgttaccgttctttttgcccatatgtgtacacgcttttacaaggttataatcatagcacaccactttgtattccagttcctactttttattataaattattgtgaatactttttctttggaaatatttatttttattaacatatgttcattgaagaacatttggaaaataaaacaatactgcccataattacaaggagataacttctgttaacattttggtttgtagcctcatagtctttttcattgattattttgtatgcttgataataatgtgttttgtgttttatatttcatatattctatttctaggtcatttgggctctttaaaaatatttactttcctaacagtttagctagtattgtagaattagtgaaaatatattagagaagtagtgttttaattttacctgcatatagttcagcaataaaaagaacacccatcctgtgatgaattatttcatggatggaaagattgctttttctaagttcaggttatctcatcagaaaccaggaaatctcagaaaatagagctatggataactaaattgatttttttaaatctgagtttcattaatagtatcaagttagaaatgacttcttgattctaattatgaagtaatacattttcaccatcgaaagaagcattgtagagaaagctaatgcctctgaatctgaaacatttataaaaattacttttgtggtaagcttagcagtatagaaatgtggagcctttaggaaacagaaatttaagcagataatcaaattcaggcagtttttcaccaagcatctgacattgtagtcacagatctttgtcctcaccagggatttttcaccttacctaatatttcacaatttatctcactttaaattgtttgagactaatcatttttcagatagaagttgatattaatgaaattaaattagaagagctggtttaaaagtcaacaaaataaaacactattaaggattatatttgtttcatccaatttctagaaagaaaacagtaatgatttgataatatgtcaatatttcatgcagacagaaagcttttacagttagcctcagtatattctgtcacaagagaaatctaaatctggacaaaaacctggtacttttatgattagagattgtcttataaaggatagtctcagtggtttgagaaggatttacatcagactattggacattactggaagaaaggtcacaaaaatatatcccatgaagcctaatttaaaaagaagagcctcttgcctataattgagatgaagttttaatgttcctgtggtaatggcatcaccgtaaatatgtaaatagagatagcatttaatagatgtagaagacctctattccacctttcaaggtgaagacctaggtttaaggcctggctccatcaacaatatgctatttggtgttgtgagattgatttctaaactgagactttaaggaatgaataggcactaaccagttcaatggatgacagggagcccccagtgcaaatgaccaaagacaaaatagagtcaataattgggtgggttcagtggctaacatctataatccctgcactttgggaggctgaggtgggaagatggcttgagctcaggagttcaagaccagactgggcaatagtgagacttttgtctccacacaaaaatttaaaaattagccaagcaaaacggtgcatgcctgtagtcccagctgatcaggaggctaaggtgggaggactgcttgagcccaggaggcagaggctgcagtgagccaagatcacaccactgcactccagcctgggtgacagagcgagaccctgtctcaaaaaataaaaaatgagtcattagttaggttcctatatctttaactaatggtttgcttgatcatattatggtttttgggagggagcatttgaagtaaatgttgacctttatagtactgacctttgaaagccttccccttctatttgctgtgcactggactagaggcaagggatgcaccctctggagccctggtcatgctatccatttcagctgtttatcttactcccatcgtgtatgtatttgtccacacccattgcctgtttccaaagcctaagtaaacctcttatcagtcaggttctgacaggaaacagatggcaactcagactgggtgactggggaaagtttaatgaactgcaaaagtatgggctaggaaccctgggaaactgtcccaatcttaggccaaaagaagccaggtgatagagccattatcaaaactctaactcagcgaggatgtttgtagctacgtttggtagaggaacacagctaatgtacagagatctggctgcaaaggaaccgggaaaatacatacccttacctcattcctcttctgccttctaagtcaccttgtgggtacctcccactgactgaatccgaggacaagccagaggacaaagtagcttgttggtgcagtccagaaagctcccttccggaggcaaagaagaaggtggggaatggtagaaggtgggtcaagagagcaaacagaagacatccagcaagtgcacactcttatttgcaattggcagcttcttaccaggtgactaaccctgcgaggaacaaaagggaaaaggaatcatgagccctactctcttgggccagcctggcaggttccctgggtttgaaatcaatcaggtgtcttctgatggatcagaacaatttttactttatttattccctcttaccttcacccctagagagctaattccagaaatacttattttggctgtggaaagtcacacaaattacagacatttattatataacacaatagtaactgtgcagatctcaatatgtatgtctggttaattctgtataagttgtttgatgataatgttaaactcttgatctgtgccaagactttggtactttcctgtccatatttcatggtcatcttctcacaatattaaagcatgtgagagcagattgcttgtaaggactttttatctctacccacaaaatgctgactcatgacagaaggcatcttggaaagagaaatggcttaagggtgtatggctctttcttcatgtgataaaaattaaacctctggcgagttgtataaagtgctttttaatatatctatatattttttcttcctactcccttaaggtctcataaaagaaatcactgtccactcatatttgggaatctttgagacagtgatccacagcctgtgtatatatgagtgtgtgaatgtgaagaagaactccttttcatttcccaaaacctttattcttgtgtatatagacagtggaggaatcagagaaagcgtgatgatgaataagtccctgaatcatttcttttctctctgctggttgaactctctcctcccaaaaagtgactgtggccttccagatattgtttctctccatttggctacttgggtctgcccttttagatgtatctagatttttgggtaattcatttagtgttataagccatttatacataaatcttgacatttggaactgctttgtcacctgtgtttctagttacacactggtataatccaggatttatccagaaaattctttcctttacccttccctaaggctaaagctgagtttttgtcttctcttccttgaatggaaggaatacttacattttttccccaggtttgcttttgaggccctttgctattttcttttaggtggtgattgaactctgtatacgaagtcctccagggagttggcctttgccatgcagtccttcttgcatacacagtccctgaagtactcaggtgctgctcaggtctcagagttcttggatgatggtacttatgagctctctatgtcgtattgcctactctatgaaccttgggagattactcttcctttttttttttttttaagttagatttaaaggagtgttttacctgaaggctcatttaaggttatttttcaaactacaaactggagcacattcatgggttatgaaatagctggttacaactggaatttttttaataacataaaataaaatagaaaatagtttgaaaaagacaaatattatatgattctacttacatgagatcccaagagtagtcaaattcataaagagcatagtggtggctgtcaggggctgtggggaggggagagtagggagtgagggtttaatggacatggagtttcagcttgggaaaatcaaaaagttctagagatggatggtggtgatggttgcacaacaatgtgaatgtacttaatgtcactgaactgtacactttaaaatggttaaaatgataaattttatgctatataagttaatatattatcacaatagaaaatagtatgcatcatattttcagaaaaccttttcccctgttttatatgtgtatactggattacaataaaagtgtgcttgttatttggagttagggttaagacatttggaaaacaaccattgtaaggagtggaagaaatgcagtgcaacaggcacacactcctgcatcctctctcacctctctcctgcgtcctctctcagccattcagcactctcacgggatggacagagcagtgttcatgcagtgggtaggggagaatttatgtgaaccaacgttgagagacagtgccccattgagatgaatgccagtatgctgttgtgagatccctcttaggaagctaaagataatcaattaacattaacctatgtagccagtatggtaccttgtcttgcccgcaagaaaaagaggaatggatttttttcatcatttgtttttaatcaagtggtggacatcatgctaagtagtttatatgcagtagctcatgtaatacttgaaaaaggtaggtctaattactgtactcattttataaatgaaaaatacagagacttagccaggtgaaataacttgcataatactatagtataaatgatagcagcgcatacattattctaggttctcctaccttggtcattctctgcttaatctcacaatcatggcggaaggcaaggaggagcaagtcatgtcttaatctctatgctatattatcctatattataaaatctttattaccataaagggatccatagagaagtgacattcagagctggatctttagggattgtgcctaggtccccacagtgccattaagataggatcagtctacatctagatgtactgaacactccttgtttaaagaattgatcccctctgtaggtcactcaggacagttggtaagtaactctttggctaaaatgaaggtataaataaaacacctgccatccttctcactgtctaggatatttccactatcctaaaaacaacacttaaataaccctctgaacttaaagctacttgaataaattactgaatcgtgaattgtgtttattactatttgagaggtcttgcttccaggaactattttccagttaaaagtgaagagcaccagataattctgtgaacactgtcattggccatgaatttgacctgttttgaaagtcttctgggaaaaggggaaatattgaaatataaatattataagttgtgatattttttacttttctttttctgcttattatacatctgatgtttgaccttttaagatgtgaatcagattaaaatccactgttgtacttaattagggaaattatacaaatgtagctactgcaagtctctagcagggtcatcactcatatttatgactatttagtcctattgtacttagatcattttaatccttaggtaaaaggtaaacacatacatgctacttttatagtatataatggtgatttaagttaagaatatcaaaaactataaatgtgctaatgtaaaataaagttgtattcaaattacatatactatattttgtgtttaagaagtgtgtgattttgttgactccgatttttaaataaaagttttaatttttgcatataaattaacctagtaaccattttagtcgggatttcaagattgaaggagtattgctgactagagtagtgctactagcactaatgcttactggagtatgattttatgattcaggagctactgtatatacctaaaaatatgtctaaccattgctttgtgcattcaatttaggaaaagtgaagaatcaatcaatttgttataagtaaagattgtattagatactcatgatgttttagcaaccttttgtaatatgttataatatttgccactctcaggagatagaaaaataaatcttggaaaatatcagagtgtcaaaaactataattggtcagaaaaatgctcaaactgtgtacccattttaaaaaactggtcccatagaactcttgcctggatttttaataatattttgactaacattgtgccctatttctaaaaacttacatgagtagtataagggaaagagttcaaatgtgtaaaacacatgtacaactaatatattttcctctttctgaataaatacaagttttaattttatcttgccaatgaaatcttttgttaactctacaaattcctagaaagttacttggattactgtgcccattatagatgttttaagaatatacttagctgcatttttgtgcatagtcaataacctagtgctccagagtctgttttctttgtctgcaatggagatttactagcattgcagtaaatgcttacaccacataactgaaaaccctttgaggttaaacaactcagtaaacatgctggaatgctcctagctttcattttcaccagcctgtttcacaacctctttcaaaacccaatggaagattcacacctctgaaaatcccacatgattcacccatgccattaagttcctcttgtgtttccaccctggcagcacttcccactttcctattcctggggggtcgttctgtttggtaatttttgtaaatgtctacgtattgagtatcaccagttagactgtgagttctttgaaaatcaaggatttgtttctttagtgcttcctgtcatagttctccctaggatactgtaaatgacattgcttgtccttaggctcctcatggatttgggagccaggctgtgatagctacagagcatatttcaggatgaaaagaagagagtggaagacagtgagctgtggggaaagggcaacattgattcggtgatccacaattaacaggacacaccttgttctcctccaacaatcccaaattcccaggtctcgtgctcctgttagcattaatgcaatctaggcagcatgcttcccgtgcacagcagcagccaccatgtgcagacatcttcccttctatggatgccatcactattcactttaatcagatttaactcatacaggctgggattggtggctcatgcctgtaaccccagcactttgggaggccaaggcgggtggatcacttggggtcaggagttcaagaccagcctgatcaacatgttgaaaccccatctctactaaaaatacaaaaattagctgggcatggtggctggcgcctgtaatcccagctacttgggaggctgaggcaggagaatcacttgaacctgggaggcagagattgcattgagccaaggttgtgccacgctgctccagcctggcctggacaacaaaagtagactccatctcaaaaaaaaaagaaaagatttaacttgtataaaatagtgttaagaggatgggcaagtgaagagaggacccatgcattgtaattgtccatgggaccctcattcttctggatatggtcataacttttatggcacccgttacagtagtgagtgagtgcttaataaagaatattgactgactcctatggaaatatgggtatggacaatctggagaagtaaaacaagggtgaaatatttatggtgacactgaagtattgggtttttgagtggcagagtcatactctgaactgcattgatcttaaactaataacagaacaaatggcccgtaagttttgtgagatgtggatggaagcacattgatttggagatcagtatgatcatagatcagtatgagttggcatttgaggaatcctttaaaagttttctgtgaacaattcatagagaataatcaacatgattccaggctggaatgcagtgcacgacagccttgacctgctgtgcttaagcaattctcccacctcaaccaccaagtagctgagactgcaggtgcatgccaccacatccagctaattttctggatgaggtgaggtctcactatgttacccaggctggtctcgaactcctgagctgaagtgatcctgctgcctcagcctcccaaagtactaggataacaagcatgagccactgcacctggccaaacacgagcttaattttaaaaaatagctaatttacataggaaaatacagaagatttgataaaatattgactataggattttcagtactagttttagaaacccttataaaaagacgtttcactcatataatattgggaaattttggttattgaacttcttttatcacttctttcccatagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacaggtactcttttttttagcatcagaataacatccatttaatacttaccattttctcttgagtgttttcaaaagagaagtcaacaatcttagataatgtattttcaggaagtataaagcgagcagtggcaaagttatcctggggttgacttggcaaaacaggcataacctttacttctgaaccagcttatgaacccattatataagttgtcaatggtattgagctgacatgtttttgaatgctacctaatgagaatttttcaaggaagttagttttactgtaattctaattatgatcttgtattagttcatttttcacgctgctgataaagacatacccaagactgggaagaaaaagagatttaatggacttacagttccacatggctggggagacctcacaatcatggtggaaggcaaggaggagcaggtcacgtcttacatggaaggcaacaggctaagagagcttgtgcagggaaactcgtttttttataaccatcagatctcgtgagacttattcactatcacgagaacagtacaggaaagacctgccccactgattcgattatctcccacaacacgtgggaattcaagatgagatttgggtggggacacaaccaaaccatatcagatccctttgaaagaaatatgtctgttcttgttcagtatcctgagtcattacattagtagcaaatagattccaaaaatacttggtattgcctgatttcaaaatcatgaatactttccacaaaagataggcacagtctcaaattaatttaaaggggtatcatttttacaagtttggaaggaagtttaaattttcccacacaccaaaagtggccttttataagcttactaatgttatttgaacaattatttctcaatatgctctgtaccaaaccttttctaggtgatacattttgactcatatattaggtttttgacctacatgtaatgaagggaagaggagaaaatcagattaaaaccaaacacagctggctgggcacagtgactcacacctgtaatcccaacactttgggaggccgaggcgggtggatcaccatgtcaggagattgagaccatcctggctaacacggtgaaaccccatctctactaaaaatacaaaaaaattagctgggcgtggtggcaggtgcctgtaatcccagctactcagaaggctaaagcaggagaatcgcttgaacccaggaggcagaggttgcagtgagccaagatcacaccactgcactccagcctgggtgacagaacaagactccatctcaaaaaaaaaaaaaaaaaatagctgttgttaagcatcttgccttttcagcaaaaatggagtttaacctgctttctctaactctctttgagtcatgtttttgttttggttttgagatttgattggtagctacagagcagttctataaaattctctttagatagatacctgcttttcagtttatttattggcttctgtgatcaattttttgtgaaagttacttttggacaatatatatttaagaggcctaattgaacaaaacagttttgttttcaaatatcaaatgggaatccaaagattataatatcttcaataaataatttgaatttattaaacaccaaaaactaatttcaataatcaaaaagtgaatagtttgaatgtcatttcactctttattttcacaaaatattggctcatcttaattgctgttttccttgtttgttttctcaacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacaggtatgcacattccataacagtttacagtttggccacatatgatcttttattaggttctgtatgctatcacttctgataataagttcaacacaaacaaaaatgttagagaatgaagaatttgatgggcaccattatacttgaggccttctctgttttggcaaagtgatgcatgttatttttgaaaaactggagaatataggttctctacacatgcattggagatcatgcccacatttttgtgactaatgcaccacatctgtgtggaaagtaacatattcccagaaattttttccaagtattgtggctttagtttgccaaagcttcaacttagctatgtatcaaattgtctaacggtccattgcagaaataaagaacctgtgtgaccctttctaatgataagcattcgatcttttcaaacaaacaaacaaaaaaagcagcgagatgaaatatgtgagtacaatacagtcttagttttttcctctactctttctgactttttgattcactaaaaagtactagataatggatttttaaatcaattagagagccttgattattttaataattttttaacttttatttcttatcagaaataaaccaaaccaaaaaaagggatgaagcgtaagtctatgataagtggcatatttaaaatgggaaacctgtccatgtctgctagcacaaaagtaacttcacagaatatttggatgataatatgttcaatgatttaagaacaaatcacttctgcttcccttactgattttagtgttatattgtatttccatcaagtttgtgttgctatttaagctgaaacatttccccacattttgtatatattacatttgtgtgaggctggctacccgagagaaacggtgcttcatcccccactgacctccttttgggatggagcagttaaggggaagaggagcttttgttctctaacttaagaatttgtatgagaataaatatttttctttatatgcatgaagacctatacaagaccaaggaattaattacctaacatggcactataatagcaaagggaaagaagataacacatctgttttatgttttaaaaatattttttaagggcattccatggttttcttgttgcaaaggacatgcgtaaaataagagctagtgtgatctaaatctttgcagctggttcaaatagccatgtgaaaaaaaagacctctatggctccaatttctgttttttggttgtattttgaacaatacatttaataaaaaacaaacctagaaaatataaaagaatcattgatagaacatttaaacccaggatatttttgtcttggtatcagaaccattataaggggactcatgtgtagcaactactgcaaaatggccttcagaaataccagtttcctcccagggtaaaaatactctcttagacacagctatacatataaataaaatatggtgcataaatatttaaatgttttaaaccacatcagagtgtgaatgactgactggctaacatagtgccttgaaggaatattctgagtttttttaatggaattgtatatttgattaagtagagccatatgtcacgtagcatattgctgacaggtacattctatgaatagttggttctgatttatacagggatttggcaacgttaacatgagccacaagaggatatacttctgtaattgttgctgtaattttcttgtttcctctcatgtcaagggtacttgccaccaagttttaatgtggtaggcacctaaccctgtgtattctaaagtaaatatgaaagtgcactactttgaaattataggacatttgacattgaaatgggcttacaaagggttattgagttcattgtttctaagatgttctgaatgtggtttatcccctttagaagcggaagtttagtttcccaaacttggattttattgtgtgtatactgctcacatatagtgtaattgctgccagtgaaaaatatgaatttaataagcaagcaaagtgattttagttctccacataccttttatcggattcatattggagacaagtcatttttccccagtgtggatggaccagacagttgaagcatgaaacaatttggccttccacctttaggtcataagttcaagattaacagaagccttcatcagtgtctgatttctctggctatagattttcttttcccttttataaatgatgactgttttgtgaaaacagattaaggatccaaaatgccatttgcaatttgttttatatttctatgtcactttcccagatttggacaaaaagtattaaaagggtttttttcttaaattaaggttacacttatgtgtcttctcttacaccaaaatggtgtatctgtttaactgcaaatgcttgtatgacactccatgaaacttaaatgtggataagccatcttttaattatgattccaagtgagcattctgaggctcaacatctatgatgtgacgtcaaatacatgtgaactttttaatattacaacagaatttaaaacattccaagaaatgcttaaacttattacagttataatgaactccacagatgaagcagcagtagagaaatagttccctgaggactttgaatattctttagaaaaatgtaaacaacccccttgtgttctttaatttacattttttcctaaaaccctcatcatttattaaaggtcagtttttagagatgaagaaagtaatatgatgttttttttctgctcaagccccatctggtaacttaacctctgtgttaccagcagattgatcccaattcattatgaaaactgaattttaatctcaggatgtgtaactaagtgggagattggaatcatatccctttcttcatgtctgtactcgcactgaaaggaaagaaaaatgtttacaagtagagcagttcatgttgattatataatgctcaatggaaaaatctcatcaaaactaattacatactatgattccagtttgattgaaggtttgtagataaatatataaaaaaggattggataggacagactagaatagtaacaggcaggacattcagaagggaaaaactatttgaagaaaattcaccaaaatgttaatagtagttattgctgagtttaaaattaaagatttttaaaaatccatacttcctgtatttcctaatttttccctccccttcttctcccctgtattttctaactttgtacagtgaatatataattataattttacaaattaaatctaccaaagttttcgtttgtttatttcctaagtatttatcggctaggcattatgctggatactgaagataaaactgtaaagaataaaaactgtaaagacgtggttgctgcccttctgcagcatacagtctaattatggagacaatattgaacccataatggtacaaattaacaagtgctctgaaggtgaaatatagaatcttatgtaagcgtaaaataggagaacctaccttgaccttgggaggatctcagaaggctgctcttaaaaccaaccttaaaacaggaatctggaagttgagtagaaacaagttggtcaagcaagaaatggagaaaaagatgtccaagcagagggaaggctctgaggcaggaagtagtttgatgtgttggatgagttggaaggaggtcagcgtagtgctggaggagctggaaaaggctagtggagctggagtgtcctgagcaaatgccctcagcaaatggagagtagctcaagatgcagttggaggcatgggcaggggctgggtaagatgattcatctaaaactcaacagcagtcaagttttgaaatcattgctaccaattaaaatccatagtagagagtattatggtagatgacagatgcttgttgttatgagtactttggtctcacttagccagaaactcttttggcgattagtgtgactatgaagcaaggttcggttcaatgggaatagatggatgatgtgagagggcttagaagtcctcaagggcctctggaagaataaggtatgtcagggccacttcaccacctgcagcatagagcctgcccacctacttcaagggcattctggatgattaggagtagattctgtttcccaagatgagtctgtaccctaatgggtacaagtctggtcatggcccaggctggattccaagtacattcatctgtagtctccttggcttcatgcctcctccgtacttgaatcacaatgcttctgagttgtatctctgtttactcccccacttctcagtaaagtggcaaatgatggagtgtgacattttgacattatttagatccatagccaggaaatagaggccaactggagaagcatcagttacatgttatctcccattatctgcaaattaattagctacttatgatgtttttcttatattctcaagttaatcatttatttagcattcttttagtttaccaaaagtatgtttattctttttaagccatagcctaaccagagtgataaaagagtaagcaaggaaatactttattactttgccagtgttttaatgtaacagcaaccaatggaggcaccattaaatgagaaaggagttatcaacaaaggaacgtattattaatttgctgcgctttagctgactaatgaaggattttagctgactgatgacttagctgaaacaaatactgaaaactgtttcaactaacattatttctcaagaaaactgcaacttggcttacactgactctggagttgatctgttttgtatgttcagcctcttaacaatagagggaaagttatggttttatttacatctctcactgagcagatttacacacacacacacatatccaccctccctcttaagggatctggggatgttttacctaaatgattcttactttctgtagggtacaaactgtggctttggtaattggtcttgattgttgagtttagaagctgggaacatggtaattctagcctccagtactctgctcaaaaacgtgcactacccagtacagcactgtttgtagcatgttaattcactttaagaaatgttaaaagtttgagggatctcattgttcttttactcttcagcgtgtatgatttattttgagggagtataaatcaaaacacattcttggaacatttaaaatctcttaaaggtattttttatgtgtgtgcttatcctggcagtatagaatactttgtataccagagctaatgacaacagatcttttagggtttctgtgttgtaacaatcgccactgggcagacagctgccaaacatcttacaattaatccgatccatgttggctttcgtatcctttttctttcagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacaggtatttgagaaacacccttacaaacagccattgttaaggttggggattcatttcttctgcacttgtgtgcctgtccagttatttccctttttaagtctccgaaggaaccacacagcgtagctacatctgacggaaacccaagagtgtttagagatgggagcacacgcttctcttggaatggagcattttcctgtttagcactggtgcttggggcgggggcagcagggtgtggtgatgaagaggctgactcgagagccaggtttggatcctagctgtgtgtaaccttgctctactttctgttcttcagttttctcatatgtaaaatgggataaaagtagtacttatttcatagggttataaggactaagtgaattcatatgtataaggcattaatacataagcattgtgttcggtattattattcatttgtttcttcagattttttttctgtgtgtgtccttggtagcaggcacatgctaggcactgggaattcaaagacaggtaagtcacaggccttgccctctgaggacagctcacaatctgtgatacaatgacagtgaaaaactatgtccaagggagcactgagaaaagacacaccaaaggatgtctgttttccaagtagtgtaatttcattttcctgtccctttagatgggaataattagagatatgtgtcctgtagcgataatatgaagatgaattaaatacaaagatgtagtcttaagtgagcaaaagaaatcctaggaagtactctcgagaataatgtatttgttaaactctgggtaataagaaaactactgcctgcttgtgattaaaagaaagtcattagattagagaacaagttttcccatctggtctctagaccagcatcagaatacattataccccttgggctccatctgagggtagctagatgctgatttcttgttttttcatcagattgccacactattggtatacaatttggaaaagtaaatataatgcagtatttcttatttaaatatatttagttcacattaatctgacaggacactgaaatacatgtctgtttttcataaaaattttttcacatgatatggtattgcattcatatttttagggtaaatcacatacccttgttttctaattttcctctttagaaatgtccatgttagaagtatttaagttgttttcctcgtgtaacataaaggatgttttatttgtttcaaattcatctatgtttaattttttttcctatggactacaaaagtgagagcatacaggtatactgacaaaaccaaacaaaaaacacctataattccaaccacctagagagaactcatgttaacacttcctgtataacctattagatcttctaagtttccattgtcattgcattcccagcaatgaattatgtgggacaggaaagaagcctctgagaagctgcagtaacatgtaattgtacactgtacctgtagccactttaccgatgcacacacagcaagctccaggccttagccggtagaaagcaaagcagaggaagcttaactctccagtcatttgaagatgcatagcttgcatatccctcagagaccctcaggattctctggacactggagccaggatgggaagggtgatcataagagaacaactggctcaggagtgtggggagcagtagtcttcatgctatagacatacagtttctgggtggagaggaggtcagcaggaaagaatgaatagacaaccactgtcaccagcacacctttcattttcatactcatttgcactatttcaaggcctttttgtatttattacaagttttatattcacagcattcctgtgcagtattatttgttatgcatattttatagataaggagacaaatagaaatgttaagttaggtagtggcagaattaggactgaattccttatcttttaattctcaatacagtgtcacttcaatgttgtctcactcccctaggttttggcagcatgatttgtctgttagaatagccaagctttgaagtttgaaaagaagggctgagaaatcactggaatagtaggccacatctaaggctaaactaataggggattcttagtccaagtatgaacccttgcaaagtcttaactgtgttaccaaaaataataggagcttcttaatcacaaactctaaacataaaacaggtatctaataaactttgttttttcttttaaatttgtaactgcatcttgtggatgcaacttttaaaataagctgcagtcattataatcttcttaagactaaaacctagataacctagataatatttataaaaaacgacgtcttcttactatatttctgtatgctaatgtaagtgggttttaggaccctctgaagccagaagccttaatgggcccagagggtcttcatgggattccttacattcattacattcacagttgaaaattctgctgtgttctaatgagaggctacatgaggatcagaaaaactagccactcagtttcaaactgcacctggagcttgtcatagatgcacaattgagcaaaatattcctttttccagactccaagtcatatcctgcattgcccagcaagctttgttttaggaacatttgtgtctgcatgtttatgctaccttgggtgttagtcaattcatagtctcagggaggatttctaaagttcacggaacttaactccactaaacaatgtagctaacattgcagagatcaagaaagtggcagtgacacctggaaaggtttcaaagaggtcaagatatcttaaaaccacacaagaggttgctaacaacagtaagtcccaataggatgaagagaaacatggacacaaccaattctagaaatccaaagctgacaaaccttttagaattgaaagtcataaaatgctccttatagtttctaacacatgctctggggcagaatcacttaacattctggatatctcacaacagtttcttgcctaaacaaacaaaggaagaagaaaactatttcctagggaataattgaatatattcagctgcacagaatcatagatgccatcacaaagggctcttaaatattccaattcagtagactttagatcaggttggatgagaacaataaccagcaagggactggtcttcaaagaagtatgtcacattatgctacgttgaatctagggaccagaagtgtgagtttatagaatgtttccccaaaatataggcagtatatgcagttcatagtcaagggaggctttgtttaatttagacaaaccagctatagtgacatctccaccaactggtaggatttatatagaggctgtttaacttccttttctagttaatagagagcactgttggttaaactgcttggaatagtattgcctttatcttgtatgtaaggatttacacttgcttttagcctcaaacatgtataatttatgggttatgcatttttttcagaattacagaattctagttaccaatgacttaattgtggtaatcaaaccatcaagcaagtggaaataggctctagacagagctatggaaaataataaaacatttatccaaaatgaatataacggaagtttcataagcttatgaaaaaatagcaaatatttaaaactacaggtcaggcatagtggtttatgcctgaaatcctaacactttgggaggctgaggcaggaggattacttgaggccagaacttctcaagaccagcctgggcaacataacaagacccaatctctataaaaaaacttaaaaatttaaaaatctaaaaattaaatttaaaaatttaaaaatctccacaaaaaaatttaaaaagtatgtgtggtggcacatacctgtagttctagctacttgggaggctgaggcaggaggattacttgagcccaggagttcaagaccagcctgggcaatataatgagaccccatcttaaaaaaaaaaaaaaaaaaaagcaaaatgtaacaaggtaaaattaattttgatgagcagcagagcatcttggaaatattcattaaacagagtgacacatagtgacaaaaatataaatcctatattactttaaagcagaggtggcaaacttttcctgtaaagggccagatagtaaatattttaagctttcaggatttacagtttgttgcagctactcaactctgtgtaaaatcagccataggtgatatgtaaacgaatgagtgtggctgtgtgccaatgaaactgtatttatgggcaataacatttaaatttcatataattttcaaacatcacaattactattcttttgattttttccatccatttaaaaatgtaaaaaccattctctgctcacaggctatccaaaaataggctacatgccaaatttggcctataagcctaagtttgccaacacttgctttaagacttctcagttgatcaaattcagtagactaaaggtttgatttaaaattgttttcactctgacctcactggtattcctatcatttgaaagcttggtacaaagttccagaaattgagaaatgacagataatagttaaaatctaacttctatgtaattaacctgtactcaccaaattacagaaaatatttttattatactcattctggtcctaatcagtacataacagaaagttctccaatttttgttttgtatgtaacaatattttaaaacgagacctggtaattttttcatttgtctaaaacggaaagcaacaggttttgagtatctgcctatcttttagtaattccagccagttgtcaatttcattaactagactgtaattcttagttactatgctttacaaatccgtttatataatgcatgtatacatatatatttagagaaagagcatatttcttgttgccacagtaacaatttaaaaacttaaaaagccgacttgggggacaaagaaatactctgtgttgccaaagctgataaatttttcaagtgttctcctatgtgtgcatgcatgttaaagtttgtttagaaagggcaaatgaatagacactattacacactggagttgctaatggaattggtactttatttctagaaagcaattgggtaagaaacttcaaagctattaaaattattgtagattttgacccagtaagtctcccagtagtaatctacccactggagagaaggcaaattaaaacaaagatttttataccataaaagttaatcacagtttgtcacaaaatatttaaagcaccaaaatgttcacttttaaggagttaagtaaaatctggcataagactatcttatagatattttatgggatctttacatttttacatggaatggaggaagtcctacctatcatatcatatcatataagtcagaaaagcagaatatgaaattctatgtatacaatgtgatcataacaacacacaagcaaatgcacaaaacatactggaaaaagacatgtcaaaatgttatcagtggttgcctctgaattttgggtaaggtgatattattctatttttgtcacatttttatgtacttttcaacttcttattaaggagaaagaaattaaatttgagacattaagcacccccacacacacacccaaaactcacatacagactaaaaggaacttcaaatattaattcttaggaacagcaccaagtgtaatgatatatcaagagtgattatctttattacttcttatacaaactattgcaatagtttttctcaattgttctcttagttaacagttttgccctgttttaactctgatttatctctcagactacagctcaagcaattttcctaaatactttgattgttacactttcctgtccagaaaccatcacatgctacaccatgatttattaaataatatccaaattatctgacctccaagggctaactcagtcttttcacaggccctcctgccattatttctctgtagctgtttatttagtctccctcacattcatttttttaatcagtatattttcatgtattacttattgcgtttaaatatatacattcttctaaggaacttactgtctattgagggacccagaaaagtaaaaaattattatagacatgacattgtctatcagtctatcaggatatcattgcagtagttcaggacagagagaaatgaggggtgaataatgaaaacactagccatagggaagaaatgccagggaatcaggaagtaaaatcaattgcatctggatatgaacaaagtcttaatgggaacccaaaggaaatgtttccaaatccaacatgaggatgggaagctggcaaggcttccagacagaagggatatttgtattacacgttaatgccttggagttagctaggccagtgaagtgagggtggaggcgatattccagctaagaggaccaacatgtgtgaaagccacagagacatgaaacaatatggcacagaaggataacttgactaatttggctacagtgtagagtacatgtgtggagctgcaagagggggaagtaggctaaggccatgagggctcctgtatgctgtgctaagaagttttaataccgtcttgaggccatgatagcacaaaggtgtgataatctacgtacccagagagatcaaagttagctttccacagaagctaagtttgaacagtaagtataggttggcccagcggatgacagtggaggagtacaccaagaagaacaagggaggtatatataaacagcaagttatggtcaagggatttcaggttttgtgcagtgtaactcaatcataaaaattgcagaagagatatgtgctggtccactggctcttagagtggtagtggtggggaacccctgattgtagggatggccaactttcatggtgtaaatactccaaagcttatttcaggctaccaatgggttgaccaccagtttgcaaaatctctaaacacttaattgctggttttcacaaacaagtatgagccagctccagcacaccactgtctggcagagttgtgttctcaagagcctgggaatccatttcaagaagatatacatctatgtgatgggcagctcttggctactgaatgagtttaagtagaggaatgccaggatcacagatgtatttcagaaaagttctactaatgtatttgagaagacggtctagagaagattgagaatacaaacagagactactatggtcactgctgcgtagtgcaggagtgagagagattatagtaactgagctaagacagagtaagggcattaaatgatataaatgcctaagaaactgatatttctgtgaataacagcaacacattctgaacagaacttaaaaaaaaaaaaaaaaaaaaaaactacctgaaggctctggagactaaacaaaggcagattttggaggggagtcaaaattttgagcaagtaatttgcaggatgactttcccatttttttggctttgccttgagggcaactgcagtcacggcagcacaggggtggcctatcatctttctggcccagggtaccaggggaaatagcctaggcatcctaggctgctagagtgtgaagagaaaaccctggagaggagaaagccataaaatgggaacataatatttttaaatgtagcccaactgttcagctgactgctgaaccacacacatgcatggggcaaactgaatgcagtttgtacccaaggcttaaagaagtaaactaacctgagctgctgctcacccaggtatgagaatttccagtttgagtctaaacaagttagttgcctgttaactacaaacatcaacactctttggagcagtcataagagaatccagattctccacaacaaaacatgtacaatgtccataatataacccaaaattacttgacagataagagtcagaaaaaaaaatgttaactcaatttccagggaaagacaattaatagatgctaatccaaagatgacccagatgttggcattatcggacatgtactctaaagtgtctgtgtcaaaggtgaagggattttacagatgtaattaaggtcctaaattagttgatttttagttaagagagaaaatcttgagtgggcctaatttaatcagattaaaaaccctaaaagagtgatcggacccttttgtaaggagagagaggcatagaggctcctgctggccttgggaagcaaactgtcatgttctgatggcctatgaagagggtcctggggcagggagctgtgggaggcctccagaaccggaagatggctgccagcaccaggcagtaagaagttaaggcccttgtcttacagccacaagaaaataaattctgccaacaacttaagcaagcttgagtagagtcttaccaagtcaagcctccagatcagaatgcagccaactgcagctcatttggagtcttatgaaccctaaacagagaacgcagctaagctatacatggactcttgaccaacagtcactgtgagagagtaaatgtgtgctgttttaagctgctaaattagtgctaatttgttacagagcaataaaaacataatagatgggccaagcatggtggttcacgcctgtaatcctagcactttgggaggccatggtgggtggatctcttgagtccaagtgttaaagagcagcctgggcaatatggcaagatcctgtctctaaaaaaaaaaaaaaaaaattaggcatggtggtgcacacctgtagtcccacctactcaggaggctgaagtgggaggattgcttgaccctttgaggcagagtttgcagagagctgagatcatgccactgcactccagcctgggcaacagagcaagaccctgtcgccaaaaaatttatatatatatatatatttggagacagggtcttgccctctccatatatatatatatatatatatatatatataaaatacatgatggaagaaaaaagtaaatttgaagataccaggaacatcattatgaaactactgaaaaacaaagataaagagaaaattttgaaagcagccagaggaaaacaacgcattacctaccacacattaggagaacaacaatcaaattactatggacttctctttagatactatggaggctagaagacagtgaaacaacatctttaaattgctgagagaaggtttaacttgatagaggtctgtttggaagatatttgggaggttaaaatcaccaggatttattattgatcatggaagagaagagtctggtttgactctgagatttcagacttaggtgatgtgttgctagttttgctattggccaagacagggagctgagtaggacaatgtttgagagacagagaatggggcagggtgtaagagcataacagagtaatcgtgacaaccattttggacacattgaattttaggctgctatagagggcaggaaggatggtatattagaaaaagcacaaatttgaagccataaatacctgagtttcactcctaaggtttgatagctgcatgaagagtggacagtttcttaatttcttggcacttcaacttcctcttctgcataattaagagactgttgtaaatattccatgtaaaacatttataaagttcctagtaaaggactcagcttggctgggtgcagtggtgcttcacacctataatcccaaaactttgggaggctaaggtaggaaagatagcttgaggccaggtatttgagactagccaggggcaacatagcaagaccctgtctaaacaaaacattctttaaagtaaaaagaacttggctctctataaccaagggttcctttttagtccttttcccctaactagacatccaaatggacatgtaaagtaagcaaattcgatgtaagaggctggagctcaaaagaatagtctgatctggagatataaatttggcctgttattggtgcctaactagaagtgggaataagtgagcattcccaaggagagagtgctaagagaagaattatctgttgctgcagaacaatgtacaatggtatacgataggcatacgataactacagtagacatttccatgtataaaagtaggaaacagaagacacacaggagtttctggtccatagaaattattaaattcaatcagataaatgttggaagtttcttaattagtactcagtattactcctgcttagaaatagctccccgttgctcgtggctttgtgcacatggctccagcctctgagtcacccattcttttccatgaaaagtagcttttgtttgcaccttgtagttttcccagcctgctttctgctggtagaattttgaaggttcagagtcctcttttcattttgtactgtctttatctctttcagtctaagttggcagtgtttctgccaatattattctttaaacaactttgtaggtctctttttattcttactgaggtttactatattagacaaaattaacacccatgtatcttttagataagcccttctctactttaagatttttctgatattactgagggacataacccttaagagtcttagaactccttttgtttgactagctctctgagccatcaatttaggtctttctaaggtctttcaaaagattttacaggcatattatttgcttcatatttagacccagcttttccaaccatgtcctggatttgatctttgctgggaagccatttcttgattttagcatcatttgcatctgataaagctaggaactttcaaaatagcaaatcctggctcctttttatctgacggtccttccttaagcttgtatctccccttgtgggttttaatattagcagcaggtagaagctaggaggcacttcaacactgcctggaaatctacttagctagatcatgtagtttattaggcaaattttctactttccatgttactgcaggtgatagtgttgaaaaactttctgccaccacatagcaaggatcccctttccacccatgtccaataacatttttcgcactctgtagctggcagtctcctgtagggccatcacgtttctattaataatctctctgaagtatgtagacattcactaacagccttctcaagttcttccagtttttactcactttccagctccaagcctcctccacattttaggcttttgttacagtagtatcccatttacagatactaaatctctattagtcacctattgctgtataaaaaattaccccaaaacttgagtagttaaagcaataagcacttattatcccacagtcttgttagtcaagaatttggggcatggtctaactaagtgattccagctcagcgtttctgataaggttgtaatcaagacatcacatggagctgcactcctctgaaggctcatctggtctggaagatccatctccaaaatacttacctacatgccttttggtaggaggcctcagcactccactacagggatctctccagagagttgctcgagtaatctcatgacatagcagctgctgtcttccagatcaagtgatccaaggcagaagccacaatatcttttatgtcctagcctcagaagtcattcattgttttatttgtaatatcctacacagatctgtcctattcagtggggggaacataaaggcacagataacaagaggcaaggattactggggctgtcttggaggtgagcttgcaaaaggatcagtagcagaatttgcgagttgggctgtgaaatagaatgtattgaggggaaataagagctatgaggaaaaccaagatgtcacaggaaaaccaggacataatggtgttttaaaatccaaaaaggatatttagggggatagaattatcagtgttgttaaatgtcctaagggaactgagtgaggtaagaattgaaaaaaagagaccattgtatttggcgattggaacatcattgatggctcaaggaaagcactttcagtagagagagggataaaagccagattacagtgggctaagaagtgaatgggaagtgacgaagtggtgatgatgagcatgaatttttttttttttgtcttaattatgtgttagctacagaaagccacaggtttaaggaacaattttaaatggaagagagttaggcacattaatatagaagaagaaagaaatgcgagattgatgatccagaagagagaatgactaatggcataaaatcttagaagggaagaaaaggaaagaattcatatcacgagtggaaggattgaccttgaatgggaagaagtttataccaaattttattgctgtttaacaaaccatcccaacacttattgacttaaaaaccatttattagctcgtgagtctgttggtcagacatctaggtgcactcaaaaggttcttctgtgggtctcacctggtctcacttaggaggctgaagtcagctggaggtcattcagggctgggtggtctacaatggcctcacccacatatttagtggtcagcaggctgtttgccaggtgtcttggttctcatccacgtgatctcaccaacaagctagccaagcttcttcacctggtaacactgtcccaggagaatgagagcagagactccaaggcctattgaacctgggctcagaattcacccagcatcacttccgctacattctgttgcgcagagcaagccacaaggttaagccagatccaaacagtaaggaactagatcttggtgagagttgctgcagagaatttgtggccatttgcaatgtaccacaatagtttcctccttgagataggagggagagaatgaagatggacatgaatatggttgaggttgtattggatgtttgctgagaatgaaagggaagaaaaagagggctttgaataaggtattgtttccacaatatttaatcctgtatcttgcttataatagacagctgataagtgttcctttatttttattattatttttttttttgagacagagttttgctctgtggcccaggctggagtgcagtggcacgtccacagctctctacagcctctgactccggggctcaagcgatcctcctacctctgcttccaaaagtgctgggattacaagagtgaaccaccacacccagccaataaatgttcattgaataagtaagttttgggatttctcaagaacatagatttaaaatcttaataataaaattgtcaacactgttctttgcataatgttggatacttttgtatatactattaatatacacagaaaagaggcactgatctcaaaatatatgcctcaatatactgtcaattcagttgggctcttaagagtagctcctggtcacacacccctccccttttcccattcctgcccctttggcctccttatggcctctaatgaaaaatcataaaataggaacatgctacaggaggagattagcaatatacttcaaattggccacaactttcatgtatgtctaactcttcacatttttgtttagccttttgtgcttattctatgaaaatttttgttgtttatcataaactgaaagtatatagtgtaatcactaaatattatatatttaaagtagatgtcattacaagttaaatttgccacatattgtctttctctaactgtggaaatagtttcccagaaatctacagtatcacccttattgttgtgtagggcacagctgtctgcaactagcagttccatttggggaggaaggattttatgcctttgctcccgagtggcagtaacaagcttctttttattgttgctgacattaagatagctaaaatcaacagtgaggtaaacacttcttgggaccatctggcaagcattttaatccaaaatattctgtaaacactgactccatttgagtacccaggaactaccgtccagccgccatcaactgcatttttatttcagttttaagcagtaattgaaatagccaaaaaaaaaaaaaaaaaggtagtctgtagggattccaggaaacttacattctctgagggagcttacagtgccttttgaagtcaccagtagaagtaaatggggtcctagcagttttggtcattaagtatttaatgcacagagcatatttggatttttttcattttctgttgggagatacattctacctaaatcagaggcagaagtttagggttgagttttccttttcctttatatttcaaagtttctttgtaaaactaatttataaaatgaccaatttcaagaattttaaagtctttcacaagaaatggcaaagataggattgtgatagggtcctttatccagtcccagggctgatttctggagttttctgcaagcctgcatgaaagagaatggggatatttcaagtgcaaagcgcccagaggaatggctgctggtgcggctaatggtctctctcttcctcccctggcaataaatctcagatattgaaatatagctttggagaaaaatatactgaagatttcttaagctttttacaagacactcaaagccttttcacaagccagtgctctgcaaatgtaaattcttgatgtctaaacataaaggtcctttactgagctaattttaaatgtgaattttaatacagagtacttggagaaaggtaatgcagctggcctattaaagcatggtattttgccatttttaagtaatgggaaatactgattaagaatgttataaagatttcagcatacataatgttgttgtctttaatcataacctgttaccatgagtctgtgtaacaaaagcattaactcagagacaatggcatacctattatactgtggcacttattatttccgtgcttttaaattatttccagaatattgaagagcttgttatttaaaggtcagaataatgcccaggacatggccaagcccactgagtgtcagatgcatggaatgttggatgacttcatagttataaaattatttcatttctcatgataattccggacttgccaagttagtgaattttaagaactctgagagcagattttaagataaatgtgaaataatccatacttctggagtcagggacttcccttcaggcattagttcatgtttgacttgcttgacttacacttggggataaaatgagttaggacaaggtcttagataccacattcccttactgggaaagaaaaccaacttgcacaactttggctggctcatatttcttgttatacaggcactaagaagcagcggttgccatgaaatactttatttaacctttacaaaaatgttttcttagtacagcaaggcagtttagttaaatgaaaataaataactgtaaaaattttggatttctcttatatccatctattgacttcttttttctaattaaaaattaaagataattacagttgtccacattgccatgatgactaaaaaatgaagtttatgtaaaaatcacttgatcttttcttaggacatgtgttggcatgtcttctattttacattaaactgaattttactgaatagtgaatgttacatctgagaacagtttaaaagaaagtttttattcaaactttaggtaggtttctctattgtttgtattttgtcaaaattgattttcaaacaaacaaaacctgacaatttgactcccagaatatttattcaaatccgaatgactaacagacagcctctccaatttcttatcttgttgctcccatttctcagctcacctaaattattcatcatcatttccttctaacatactgttaactctcccactgaagaattgggtctaaccaaatgcatgatcaccattgactatcattctgttaagagtttgtctgcatagcatcagaatctcctggttgttgacataacttaagcaatcaaagtcgtatttattttacttatttttaaaaaaagaaaatgtgaattatttcagattttatagacagtccctcctcttctgtatgtacatatatatcaaagttctttgaatctgtgcttttcaaccctttgtggtggtaccaagggtaaacagtcttaaggactgtcacacaattctagacttaaggcagctgttaatatcacagctcatgttttttcagtcacgtatcatttatagggaagcctttagaagaatgaaaacaatagatatgtataatgttgaaatgacctatttaaaacaagcctatttatcatttcatacttttttaactgtatttatatctgatttcatgattgaaatggtcaaaaaaagttatgcataaaatttaaaaatgaaatattttaatgcatgaaacatctttctcattaaatctttttgcaaaaatgtttatgcagtatattagttttccctaatttagttcacttagatttaatttttttttagcccagaatacccatgaagcatctcattgttttgtagaaaataatttaaatgaaaaatgctactattttccccacttttctttttttaggttattttacatatgtaaacttcagccagagattgaacagagaaaattcctgaacaataaaaatccataaataaattcttgaatttagagttgtgtttatagttatttgtgaaaaataataaaaagattctatggcttgattataggtatgttgaaacatggattaagccttaatgtttgctagaaacatgtgaaatttgataccctgacttacccagggaaattcaaatgactattacaaagtatatgatgaaatgacacaatgcactgttttaaagctatgaagaatatagatataacatatgagtagcattatttcaaacagccaaacagtgactttcttgtcagttactttgttccattgtctctcacgtatcaatccctggtgtttattgatgattgatgctctgagaggaaatagcagttactgacctaagagttcactttctcttcacccttccttcctatatctctctcccaccctctgtctcaagatttgacctcctaaaacaatgatttttttattccagagtgactccttctttccaaaatcaatattcagtgactccatttgggttacaatcaaaactattagaggaaagtaagctgacaagttgataatagaaagttaattttctaaattctgttgacaaaacaaatgaccaggagttgttttcacaaatagtttgaagccatagcttgctgcatttatggcttgtctttgtttctaacacagtcggtatgctttgtagacacaaattttgtgcagaaagaactactccctccctggttgtcacatgacaggttaggttgtcacctacttttgtttatcggaagtaacattactgtcatcttttgttctatttcaacatgtctttcttattttggggagtaagtaaaatacattctctggtccaacttttaacttccccaagcagaacacctcagaagccctatgtttttcttactctaaaaacattttgcagtgtaattattcttactgaatatctgtttatcctactatattgtaagcattttcagcccaagtgtactgtctagttcttttctgtacctaccatgtgtagtacagttagttggcttatagtaaacatttaatagctgtaaatccttaaaaatacttgccaaattgagccaggtacagtggtgcatgtctgcagttccagtacttggggaggcaaaggtgggcagattgcttgagttcagaagttcaagagcagcctgggcaacacggcaaaacactatctctacaaaagatacaaaaattagtcgggcattatggtgcatgcctgtagtcccaactactcagaaggctgaggtgggaggatcacttgagcccaggaggttgaggctacagtgagtcatgatcgtgccactacactcaagtctgggcaataaagggaaacccagtctcaaataaaaaaaaaaaaaacaagctgtggccctagggaaaaaagctcacataattgcattaaatggctcctaagaatcatgtgaatatgtaatatagcaatatagcaagccagactctgtgctaggaattatggagactacagagatgaactgaagatcatgtcaccctcttggcaaagtgccaagagggcaagttgggaaaatttggctttcattaggaggttgaacttgaatttttaaaatagaaatgtgtaatttctttttacctaaaaatgtgacctctgtatgcatcctattagacattttttttattttaataacatttttgtctgattgccaaataagacatagttgtaatacaaaatttggaaattacctgaggaagcacacaaaacacacatggaaaaaaggaaacttaaaatgcataatcctataaccctaaaataaccactgttagcattatggcttatttctagcctttttcttcctttggaataggtatacatactttttgtttatttgttttacaaaaatggggtgtactgcccatacctttttgtaatgtgtgtttttcaattaatctgttgttaactgatagcattaacatgttttcctgctatgactgtttttcagtcatttgaaagtgctctacagtgtaagtatagttttgaatagaggctctaagtaatttcagatcttttatctttcccttcccaacactctggccctgaagaaatcactcagcctctgtgtacctccatttgttttttcatctgtctaccttacaagattgttttaaggaataagtaatattaaaaatcacttagcccagtgcttgacacataatgtctaataaaggaaagctgtttttatttttactgtgttatttgaccaatttcctaatgctgccaaatttttattaaaatagcactgggataaacatacatctagatacattctttacacacatctgtaattattaccttaggatagattatttcatagaattgatgcatcaataggtattacaagtaagatttttttatataaggattacctttcagccacaatttttattccaaccagctttttatgaatgtgtcaggtttccctctattgtaagaggttgtttcatgctaattgcacagtatttgtggccttcagttaattcagataatcttgagagagaacttacagcacccatagtttgtggaagaatagccaacacttatatcacgacaatgcagcctccattatatcacaccctgaatgatttagaaaggctttctcagttgagcttactttctctttttctttttcctaccaaaacaaactacatcaaagggtccaaaaataaaattcagttgtatttatttaaacttactcttttaggtgggaaattatattctataaatgtgaaaggatatgcagggccctcagaattttagcattaaaagtttcagcattgaattgacaccaagcattagtcattacctagaaatttttctacttagtttttggcattatttcagataacgttgaacatcctgaaattcaaattccttgaaaaagcaataataagcaacatatttcatttttatgctaatttagtagtgtggaatgtactatcagttccacttagactcatgtattccaagcaagtgatttaatttcgattcaattgactttccagagagtattttggatagacaagaattattttagtattttaacttaatttttactcatgatgctcacctattgtatcattttgggcctacttgatattttaatatcagtactgcagtatctgaattatgaatctgagggattacactgacttggcgtttaatctaatattattatccctgtaagacaaatctgtgttgaaagatcattcaaaataggaaactcttgtaaatatcttgatttaatactcattttggtttgggttttgtttcgacattcttgagtttatttggacagacctggggtgagagggcccagcacctaaaagaaggtgttgggcctcgtggtgttgaagcttggcttgtgctggcgacgcaggatgccatgaggcagcaggaattcgatctcggagttgtagaatggcttggctgatggctggcagcacttgctggctgcagttttttctgccttcatgatctggattgagtgggcccaggcacagtacccagtgtccatgtcttagtctgcagaaaataggaggcagggtgaccacattcaccaggatttgggcatatggccaacctcctatcaagtatctggcacatcctgtttggtatagtaattgcctggggaccgcaactggggactgaattggggacggagtgactgcagtctctggccccaggaggcactcatactaattctgtgataccattttatgaacaaatatcaccactgacattttaagatatttactgttggttattttgtattaatcttgatttatttattcaacaaatatttattgaatgcctgccatacactaggctcttgggatattacgatgagtttagaagtttataaaataaatgggccgggttcaatagctcatacctgtaatcctagcactttgggaggccaagggggaagaattgattgaggccaggagttcaagaccaccctgggcaaaataacaagacctcatctttacaaaaaatagaaaaatttgaaaaagccaggcatggtggcatatacctatagtcctagctactcgggaggctgaggcaggaagatcacttgaggggtcaggatttcaaggttgcagtgagctatgatgacaccactgcactccagtctgggcaatagagttgactctatctctaaaacataataaaataaatggtgcctaagttttgatatataaataatatataaaaatatattaccagaatatatatatatatatacagtagtttatttcacttggattgcatgttaatttttaagaactcttaaaatttctacaatgaatacaatggattgggacattttttgaagttgtttaaatctccagtttctgtttagaacattacgtattactgtagggtaaattactataaaatgcaaaaaaaaaaatacacaaatgagtgtgaagataaaattttaatttgtgattattgaagtagaaaaaatcttgacagtagttttaaaatgaatagtgaaatatgtaacttcacaaaaaagtatttggtacctttatcatttatgttttaagatgcagtttaacattttttatttaaccatccactttctcttctttggtgtactctgttttcctagattttatcttatttttctttcctcttaaatatatcaattcaggaattctccctttggacaaaactgtaggtggtcctcagggctgatccccaattccctgatcagtaattctgttttaagttttattttgtatagaaaaaaaatgagttgaaaactgtatatgcttccatctgaggtcttcaatgggaaaactatgaatttagtctggctgccagcgcagctctgggggtctgctggaaaaaaagaaaatgtactctcttgggaccttccatcgagtgtggccactatacaacctgccttattgcttagttttagttgtcatcgaaaacttccaacaagaatagttcctgtttgacttttccccccaccgtggaaaatattagacactatctaagtagaccaaagagactgaaaagcctggatagattgaatgatggtaggggaagtaaggaaggaaaatcttaatagaaaagaggtgaaagaaaatttccaaattgataaaagaacacaaaaatgccctgggcttcaggcagaagggatagttattttctgtgaagcccattgctttcctctcccctgtatttctagcccacgttgcccctcatgcaactcctgcagtcttcctgcctctccacgtgctctcactctttgtcagcacattgctcacttatagggaagatatcagtgactatccactaattcctgcataaagtgcaaattccttagtttagtaaatcagtgccagccacaatctaaatctatgtatttaaccttatcctccaaccctttatccacgttcccttttctctcgccagttgagatggttaaccttgtcccgagcatgtgtactactttgcacatctcacattgtctttttggcatgggaaggaactatcatctttgccagttgaaatcctacccaaactctgagacccagctgcttcccaatgttttcttaatcacagcaacctgatccagacccttccttaactggactactatgtgactgctcctctcctttcctgactgcttcatgttagttatttgttcttgccttattttccctatgtgatcataagctccttgtggggcaaagaacatatctcttcctctatatttcctccatagtgcctagcatattaccttccttatagtacttgagtaatgaaaatgtgttggataatgatcgaaatctcatttgaatcaggtgatctaacacaaatgtcacatttttttgtgcctgattttatgcttccttctgtatagaaataaaaataggtatgcaagtatttgttactaaatggagacttacagtatctgtagcagtgaaatttagtcagtgggtccaacaagaacaaaacctctcacgttagctaggtgtctgtgcatatctgagcactcactgccatccagtgctcaaatccagtgccgcgggttcccaggcaggggtgattacaccatgggaaggaaaactgaagtactgctaggcctcctgaatttctttttgttggtttctctcaagaatgtagttcctttcctaatgaattatatgcatctaattgccaatgatatttagatgttttttaacagtagaccaaacattacaaatgttccattgattatgcatatgggaagaagtgttacaaatgcttttctcccacttaattttcctgtgtgaactaaatccaaacatatctgaattttcataattcaaagaaaatatctgtgccaacattctgagaacaaatagctgccaagcaaaacctgacagcatattccttggtgacatccagtctttaaaagctgtgtacacagagtgagcagctatctaaaactgagctcatatgcaaatgtgaacattcctcacttaaaattacattgtgtacattaaaactttctctagagtctatgaaatgttcaggaaaaatgtagctgagcttgatcttaagtaccttgcctcattatttttttttttttgtcatttctagctactagtctgtccaaagaaaacaactttcttatttcttttagttttgtgtgtaccctgagcttgattcccagttgctgctataaaaaactgaaagggttcccaacactgctatttttctttttttctctgttactaacatttaaacatcaaagatattctggtacttttatgttgtagagtatatataagaccatattttccctaaaggtatttactatccagggtgtgtttgtgtgtgtgtgtgtgtgtgtgtgtgtacgcacacgtgtgttttcttagctgttagccttttttagaagtcacctaactgatagcattttcctatcacaagatcactggcagtgcgtggaggaagaacttgagtgaggccatattaacagcagggagatgagttaggagatttttaaaaataatgtattcagatttaaaaaaaaaaaaaaaaaagccctatcttaacatcgaaaacgtatgttgtgatgaccttgggaattttttaaatttaagcatgttatcaggactcctcctaaggctgaaactaaaaactaacctgcttccaccaagacatttaatattatggcaatttccatgtaaatccttaatgtatttattattagggccttttatgatagtcttacaggaggttttcaaagttttattctgtctactaattgggagtttttcatgagatttacctttggttagctctgttaaaaaattatatgtgatatgaaagaaagatttaaattgtttgcatatgatataaatatatctttcttaaaatatcagttttcagccaggtgcagtggctcacgcctgtaatcctagcactttgggaggccgaggcaagcgatcttgaggtcaagagatcgagaccagcctggccaacatggtgaaacctcatctctactaaaaatacaaaaattagccagtcgtggtggcacacctgtagtcccagctactcgggaggctgaggcaagagaatcgcttgaacccaggacgtggaggttgcagtgagctgagatcgtgtcactgcactccagcctggcaacagagcgagactcaaaaaaaaaaaaaaaaaaaagtcagttgtctttccttgtacttacaaatcatagaacgttgttttcatttaaacctgtttcctacaaaagtactaattattattattttttggaatactcatatagttaaactgattttcttagctgcagttagtgggtaagagtagaaataggacatatatgaccccaaaacaaatccaaacatgaccagacatggcaatgctacatgaataaatataaatatgtatcaggaggctcagttggtaaatgttacaataagtacataacaaaaaaaaaaaagaacaaatacatcatatcttacatttaaaatgttgagggtatttctaatttgatatatctgtgatctcataaggaaagtatattaaatgaattgcatcttcaaactgctattttgttctttatcaaaagaaaaaaggtatgacaattgatgattaaaaaaaaaacccacaaaccaaatttagctttcattactgtctagccataagaaggaaaaaaccgtcagccaataccaaggttctttgatctcacgcttcaacctttttgtcctccagatgaatgaaatgatcttttctcaaatgttcagcaggccttttaccatttgataggaaaattatttttaagaaggtttaaaatgtgatctgaaaaaccacattgactctatgtgacatatttgctattcttagcctggtggaataagttggaagtggatgaataatgcaggttagaaagaaaacagatgcaaaatattacaaatggaaaggttttccagcaatgagactttcattttaggactaggtttttgttggcacgtttggcattatgacgattattgtttttttctccagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacaggtaagtttctttgtgttcatgacccagacacctcttaattattcagtgtaatggagatgaaaataattaataatttttttaaaatcacagtggttatgcctagttatatctactactaccatgcatgtgagcatttaataaatgcttatctatgatcctgacaatgatgatggcttcaaaccctttgtcccacttcttttacaagagctgctaacaagcagtaaaatttactgattttagtttcacctcttctccctgtcaccacctaccttctggtggaggtgctaatgagctgtgaaatagccaaaagtcctttattgagaaggaaaagaagcaaagagtagtgggaaccctggataatccaccagcggataaccaagagttggttctcatgcacgtgagaatgatctgtaaggaagtgctgtgatactctcccatgacagagtgggcctgggtctccagcaagcttttcttttcctaggagttaatattaactgcagtaaaaattcactgcagcctaactcttggcatataaaacctcagctctcagcacatatttttacgtattttataaaacttgctttttggctgtttttgaagttctaagactgcaaagggaaaaaagtatctgacactttctttttgttcttaagatgtgaaaatgtggtttctaaaagatgtttttcaagcatggacaagagtagaaagaaaagaaggaagtattaaaatctgaaaactggcttcactgcacacataataactggatttgtcgttagagtttcaacatatacatctggattgtaacagtctacccagagcttttgtgggacatgatagaaacagcacttagtccctggaaaaggggagcttcccctatggagcagcaggggctattctgttgctgcatgccaaggaggaatcaggaagctgctagtgaggtgaacagtaggacccacaccatatgcattcttggtctgcacctaatcaaggagctggacttggtgatcttattattgtgggccacggaaataaaaagagaactcaactctagcagaggagtctcagaaaagaagcatggaagactcttcccaattaactgagcattcctcagaatatttattgattgcctaaagtggaacaaagtaaaatggaaaacaccaagtatgtgaaacagtctttgcttttaaattgcaattttatgtaagcccaacaatgttgtcaactgacagtaagtgtaaagggaatttagaggtttcactgagaagatatgacttgagctgggctttggaaaatatgtagaatttggattaagagagagcattccaagtagacagtatagcataaacgaagagacaaatgtgggacaaatgagtcttactgaaggattcctgcagggaccggcctactagtgtgagcattgagccaaagagaacaaggagtgtcactaactcccatctgccctcagaacactcttacatgaatctgctgtcaatgaatatctgcccagtaagtgtatactggttttctgattctgtcactcatggtctttcaagaatgtcttacccaccttcccattgagtaatatgtctgagaaaaggtcatccagcctctttgaatagttcagatgacaagaggctcattccctcacacagcagccctttctgtttgctaccaccagctaagttttcttcctgatttcgaaccaaaaatctttcaccattccaccacctttccccattccctagaactatgaggcatatacaacaagcgcaaaacttgtgagaactccacaagtcacctctcctctacattatagcccttcaaaaacataagggaagctattgtgtttccccttggttttcttctctctaggccttctcaaatttgagtatgcatcagaatcccctggagggcttgttaaaacacagattgctgggtcccaaccccagagtttcagattgggtgtggtctgtaatttgcatttctaacaagttcccaggtgctgctgatgctgctggtccagggaccacaatttgactactatagctccagtctaaactttcccaggtagttcagctcattttagtgtggctgctagaacatttatcagttactgaaatggcagggtccctccatagagaaatggttttaatggtatgtcctcgtagtcaagatcataggcaacttggctgtatccgcttgctagctgtgtgatcttcagaaagtcatttaaactctgtgaatcaatttcctcatctgtaaaatgaggatagtaatagtgccctcctcaggaagttagtgtgaggattaactgagtttgtgtatgtaaaatgcttacaacgtgcctgccctcctgccatagccctatataccatatttaaaattactctaatgaaatgttatcaggcatgagtaacactaagttggacggttttgtattataacaatagtgactcattcttgaatagatactatatattttcaagaaacaatgttaaatttcagggataaattaatatatacagtgttcctgcacaaatattacacatcgcaacagtatacctaccaaatgtcataaaagttggttatttgaaaaatacatttctaaaaatgtctggcagttttacctcttccctgccccctcactcactcagatacacacacccacaagcaaaaatgttaaatgtctttttcaattggatttaatttttgctgtcagggtagtttagcgttcagatttgttctggttaaagtacatcagagacgtaggatttcctcaattggcaaggttgggaaggaagaagggaaccaagcttcagaagagctttgtggattcttgtctccctcacatcttggcttctttccttctaccccacctgggcctggaaatttgcaataaactgcagctgcctaattaccagggcccatttggggaggtgagtatatgcagatccctgatgcaccttaacaccccctggataatggagaattggctaaagctcttttcttaacattgatgctgggttatctgtgctctgcatttcttatacccctctcatttccctcaattgaatgaaaattgaccacagaaaattttgtgggaactttgtatgttctacaactactatgtacacacatttgcttccatgtttcccatctttttgttgaagaaacctttactactctaaaatctcaaatgtacacatgtatgtatgtataatggtgtctttatacacatacttttaatcatgtttaagatatcgttttccagtgcatctggtgctctggagttattcttcaatatcactattcttcttggcactgatctaataagagttctgaaacctgctaagtaaaatcatatgtggaaatcttcaatacacatctttgtggctttggggaaggaggggaattagtgtgaaacctggaaatgtgtattaaagagaaaccgtgcatttaaaaaaattaagtagctgtcttcaactgataaattaatcttgaaattctaaccataattttcaaaataaaggcattgtaagttttgccactttgaagaaaagcagatagagctctcctgagcctaaccctggaacagccgtgcaagcacactactccactgagtgaccatttttggattttctttcatctaaagtagccttccctccctggccacttttaagaattttcttttatcaaatttgaaagcctatttaacaggctttttagttgaaaatgagactataaaaacccaccaagaggatctttgtctttaaacaaagtgagtcccagatggttgtggagattctgtggtttctctgagaaacagccaaattctcttctaaatctcctggggtccaaaggttctgaagcaagagccatgtgcatatattgccaggcttgggcacatcaagaataacagagttaaataatgcttcagagttttcaaatgtttatttcaagttaggcaatgctatggcatcataagacttatcatgagtgtctagtaacccctagcatatgctaaagaaaagtttgcttcctaatttaggatcatagttcagttgacttttatggtttgttattgtgaaagcatagttttaaaagattatgatggctagagtatctaggggaaatacaactgttcagcacagcttggttttacagatgtgctccttctaaagaaaattcaaataagcagatagttgagaaataaatgagaaaatctaaacctcaccattcaaataatgcaaattaaaacaacaatgacatttaatttttggttcctcaatctagcaggtttcttttgattaaataatagttcatcccagcgtagtggcttatgcctatgatcccagcactttgggaggctgaggcaggagaatcacttgagcccaggggtttgagaccagcgtggtcaacatagcaagaccctatctctacaaaacataaaataaaatacattagccaggcatggtggcatgtgcctgtagtccaagctacttaggaggctgaggcaagaagatcccttgagccgaggagttcaaggctgcagtgagctgaaatcttgccactgcattccaccttgggtgacagagcaagacccccatctaaaaatagtgataataataatagttcatttataaatagttattcatatttattggtgtaaataatagttcattaaaattgatggttacagagaactcttgatgacataggaaaatgtatcagttaggacgctttcagtttgaagttacaaaatatgcttgttaatcttcatagcaagttaatgaggcagatactattctattttatgtttattgtttcacataacgaggaggaagaaggctggttcagtattggctaagcaacccagtgttgtatttgcttctctgtcatcctcttagatttgcctgcctggtctcaggtggcattaaagctgtatacatcctctgataacagcttctgtgacacaaaagaagggcttctcttctcaaactgtctcccttattatcaaggagtaatatctttcctagagccttttaccagtcttaccttctcatattattagccaaaccagagttccatgtttaccctgatcgatggcaaaaggagaatggaattaacaggattggcttgtaccaatcatgatacagccactgggggccaagggaggtgtctaccttccctgagtactttgctgccttttgatacctaaccaaatcaagtgagggtttttaacaataagaggaaaggagagaacagctattgggaagagaagcaatggtgtctgacacatttatgttataaagagcagcccttactttcttttttatggtttctaacttttcttaatgagtagatattaattttatgagagacagactatcagggtgatgatcaacaaactctgggccagacttactgggtaacaccaagcaagttattaaatatctctgttaaattttctctctgttaagatggggagtcacagtagcacctactttataaggttgctgtgagaatgtgttctccagaaaaaccgcactgatgagggggtgtgtgtgtgcacacccatgcatgcacacatgtacatgcatgggtgtgtgggaaaagaatgatttattataaattgactcgtgattatgaaacatgacataatcttagagaagtcccaagatctgcagtcagcaagctgcagacccaggagagccaatgtgtagctcccatctgattacaaaggccagagaaccaggagagcgaatagtgtaagttccagtccaaagtctggcaagttcaagacccaagaagagctgatgcttcattccaagtccaaaggccagaaaagaccaatgccctagctcaagcagtcaggcaaaatgagtttcctcttacttagccttttccttcgattgggtcttcatttggttagatgaagcccacccatggtggggaagacaatctgctttactcagtctaccaatccaaatgttcatctcactcagaaacaccctcacacacacacccagaataatgtttgactaaatgtctgctcataccatgacccaatcaagttgacatactaaaattaaatatcatatgcttagacttgtacatatactgtgtatgtgtgtgtgtgttattctggaaaaatattacaaataggaaattcagtatgtgaaagtcctattttctccaatcatggtgaatattcatattacagaaggatttgctttgtgaaagaattcaccaccgtattaaattttgcattatattttcaatttcaaccaatttaagaaaacatttgttgttttttgtagaaatagggtcttgctctgtcacccagggtggagtacagtggtgcaattacagttcactgcagccttgaactcctgggctcgagtgatactcctgcctcagcctcccaagtagctgtgactacaggcatacaccaccatacctagctaatttttaaattttttgtatagatgggatcttgccatgttgcccaggctagtctcaaactcctaaccttggcctctaccaggccccccatttgttttctctctctctctctcttttttttttttagacggagttttactcttgttgcccaggctggagtgcaatggtgtgatctcggctcaccgcaacctccacctgccaggttcaagtgattctcctgcctcagcctcctgagtagctgggattacaggcatgtgccaccatgcccagctaattttgtatttttagtagagacagggtttctccatgttggtcaggctggtctcgaactcccgacctcaggtgatccacctgccttggcctcccaaactgctgggattacaggcgtgaaccaccgcacctggccaagacccccatttcttaatacctactatgaactatactctcttacctgggtgtaaagttgaataacccataggtttagtggataaatctgtgtgtttataaagataaaacttacacagtttaggccaggcacagtagctcatgcttgtaatcccagcattttgggaggctggggtgtgaagattacttgagctcaggagtttgagaccagcctaggcaacactgaaaccccatcctacaaaaaaacacaaaagttagcgaggtggggtggtgcattccctgtagacccagctactctagaggctgaggtgggaggattgcttgagcctggtagattgagactgcagtgagctgtgatcatgccactacactccagcctgggcgaaagagcaagaccctgtctaaaaaaaactaaataaataaactgaataaaataaaaaaaattagatatctgcatcaaagattttgtattatctgtttatacagagatttcttactagataagagtgaaataaacccttgaaaatcaacttcaaggaatagattgatcacaattgccctctcagttaccagagctaaatgattttcaattcccagtcttttccatttctacttcacttgacaagattcactgccacctcctgggcaggcacttctcttatggcttcagcaaaactactgtcccctgattcacctctgttctccttcatcccttcttctctggccccattttctagcttttcaccccgagtctgcccttggagtattggtcagtttctgggtttgagcttctaccctctctttcaggtaaactatcttctgcttgtgcatgtttgcaaggctcttctttcactaatcattatctccacctccacattttctctggccagcacctgagcagcatttctaattgagtactggactcctacatgtctgtcctttaaatactgcaaactcaacatggccaaagcaaaatttcttcttgacttcaagtcttttttccttcttgtactgtttaagctaattacttcattttctttccattaacatcaacatagtttactctgtttgaatgataacatatttccagttaatgaagtctgaattgatgaagccttatatacttaactgtcttttagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtttgaaaagacgttcaatctagaatagagcagctttaccattgaaattttctcaaaatgttctttactcgtacagcacttaatttattaaaaagtgacatataaaaaaggggagtgaaaggctttgaatagtacttctcaaactgtttcctccccatcccacgacaatacatttgtatcagttccagtagttcttacagccaagactctgtccctcccagacgcaagtgatatcttgaaaaagattctgctgccccagggttaggggtagggtgggactgtgggggtggtatcctcctcacttaaggatctttatgatggtctgttactttatctcttcctcagtctttaccatcatcactttcattcccataaaggataaattctctttcattttgccacttagtcttatatctctccttatgcaaatctctttgtctttatggaaagagttggccccgctgactcactgcacatttgctttctgccataatgaagtctgtttttgctcagttttttttaataatggctttttccctaaactttaaactctttttaatcttccaaactgatgtatctgtgccttattttgattaattagtaaactgcttagtattcaataggaccctttgctatttcatgtgcaggtgccatcttcaaacagttccattatttatgtctggtgcacagttttgactttagaacccaactctcaagtgcaacaacgaatggtgagtgctttcccaatcctaaaatatggtatatgactctgacctttcctgttctgaaataaattaaggtcagagtgacccagggaagagatttattacaagtttgtttcagcatcaaacagctggaatactgcaacaaagcaaatatgaaagttgttctatccttttatttttatagattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaaggtactagaaaaatccttccatacattttacattttcctaggagaaattaagtagaaaagtaaccttgcactggggggcggcgggggaggggtgggtagggagatgggagtggagggagttttttgtatgatttcttatcttatgagaatgttattttaaaattgccctgcctagggatctcttattctcatctgtagttttagataaaaatcagcctttctcattaagcttagaaataaccagcagggatcatcagaacttttaatttaatttaggtttcattgacacatgacttctgtggtgaaagaagatgtgaatagagatcaacacccaggaattgaggggtgggggaagaaagaggaaaagccagggcccagatcatccacacactgtcccataaatggactctatctaccaaaaaggtgttggtctataatacatttgtagttagatatttttcaataaattatataccactttagaaatctgataattattcttggtttttatttcaatttcctagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggtaatattcttcagtgatctttttctacaaaaatttctcaacattaacaaatgatcattcacaaaaatattaaataccataagtggtgtgtgcatgtatctgtcagattcttaccttttatcatctagtaggtgtattttgtagatttctttattcatgatctagatcataattgcatgaaaagttgctttctcctgcatgcaaatttagcattgaaagattctggtatgaggaggtatcatgcaggagcatggtgtgtttggaatctttaaacatatttcacaaatattaaagttatcatatttcattgagtctcttggatgtggtttttggaacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggtactataacttttttaactaatacgaattcttatctctcaacaagtagattttattgtaaagttgcgtttatgatcttaacagaatgaatcagttgtgaaaaattcttcttagatgcatatgtaagaggtatggaatgttctttgatattcaaggacttttctgatgtcttttttttttaaccatcaacactattggtgcttgagttaccattaaatttgataacttggattagttacattcttatttccattgttataggatatttgacaagtatttgggctgctctatcagtacatattaaggaaatagagccatcatgtgtgcttatccataccctaggtactctttgctgttcttctggaaattctctgcaatctgcaagatattgaggatttcagagcaactgtttttgtcagggacccctttcctttataggtggacttggatgttcataattatggatgtctacccagttgattataacagtgtggaatgattactgacacagagagaaacctaattgcaaaacaaaatatcgcaggaaaattttatatttctgtcacaaaaccttctttataaggctagtctatttcaagaagacacacaaatctatttaaaaaatagagtaaaagtaactcctaaataaaatgtctttctgatagagaacaatttcagaatccttttttgagctccaggtcataaacatctttatttaattgcattttttcttttttctgtaaaataatcaggtgatgttaccttatggaattggaatgttgacctatgtggacctaatgttgcatattattctcttgtcaaatgagatgaaaccttcagtttttaaagcctttggtatttgcagggtagtcactgtttgggtttggttttcccctcccttccgtaaatacgaattccattgtgagtaaaaaaaaaaaaatacattgggagccaaaatagaatgtacgttgtcattacaaaacacacacacacacacacacacacacacacacacacacacacacacacacacacacacacacaccatggagggatatttggttaccttagtagacctattatataatattaaaaaaaaaatcctgaggattgaagtaaaaaatatcaaaggtaagaaaattactttataattgaggcattatttttccaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaaggtaagatcaaagtctatgtggctgggaggaaatagcatgccatccccttaacctgtctaaaatgaatctgcctttttctttttgatacctttttcatattacttcttctaaacaatttataacagtacatttgatttcttaacttcttagacctctgttttacagtgcttttttttctttaccagtgataaaagctgtgtcacataatttatccaataattgttctatttcagaatactcagcagtaacttgatttatagtatgtggggagaaaatgaacttactccaaaatatccacaaattgtacttggcctccttctttagagcagaaagtagagtcactaacgttctgagcatagagtgaaaggacaaaggctcctcctgcagcaaagtttatatttctggaaaggacatcctgagaaaaattatgtggatcaattctaattctctcctagaaccactgttatatgaggaagttatattcttgaacagtggactggtgtctatgtttttggagatgcatacaaaaaacataagtcatttaaatataaatggtatgtgcttttcagcataaatctaaagtctatgaaaacaattagctgaataatataactaatcacattatgtatgaaagtacaatatcatagtgtaccatgcagaagttttttgctgtacttctaatatcatcattattttagctgtccaaaattagaaaaagaagggatacttcatcagagtagtagaattcagattgacctttttcaggggagaagttagatttttgacaagtgtctttgaaaagtcttttgagaaaagttagggtcatttggtgactttttaaaaaataaatttccgtgataccaagaaattggtctttcttcagcattcaaggctggtatccatttcctcaaagttgtctgggcaacacatgtttatgctctgacggccaaagtactgtaacatgggtgtaaatggcaaagagctgtaagcatgaatcacccaaagttgaatagttgtaagttgagaactaccatcaaaacctggaaaaaatgttataatattcagtcaacacccaatacctctagcacctaacaaagtagccacagcaagtgttgaataaatgtttgtgaatcaatgaatgtactgttggaacacatattgatgtctaattatgctttggtagtgactcaggacctctttatactctttttagtctcaggacccctttatactcttaaaaattattgagaacccccaaagaccttttgtttctgtgggttatatcagtatttatcagattagaaattaaaacagaaacttttaaaacacaagaatatacaaatatatattccattagctatcacagtaataacatctcatgtcatgtacctctggaaatccactgtacgttcatgagagaattcaagtgtaaaagattaatagcatcttactattattataaaaatagttttgaccgtgggaccccatgcccagagatcccctgtgggtccccagaccaccctttgaaaaccagtgttctgatactattaactagatgggtatgtttaagcaagaaacatcttctctgagcatcagttccttacataacatgataaggtaatgaaatgatacatgtagtggttaagagcagcaccacagagccagactgcatgggttccaaccccctagttagaccctcttcatctttgtgaccttggggaagttacttctttgtgcctcactttcctcttctgtaaaatggggttaataatagtaactcccccacgtaggtactgtgaggattttgtgagttaatatgtatacagcacttgaaactagtggaacacaatattgcaatatatgaaggtcaatccttattgtcttcattgtcgtcattactgaagttctcagaactctccttggttcatcataggcattagtgaggcagctgctgggagaccatgaggaggaggaggaggaggagtgaggctgggtggaattctgccaagtaagatgagtggcatttatttacatatacatgctttctaaataaacactttgtgaggttactggtaaaataaccagaaaacaagtcttttatctgtcactacagaacagcagcaaaagtaacagggctgctaaagcaccatgttgtaggctaaatactgacaggggccagaacatttctgagaatgaaaggaacgccattaaatattctggggaaaaacaaaggtaaaattggtactgtcctggcagacaattagataaaataaccttttaggaatactcaagagattttgatatgccttacagtattgtcaaaattattttttctcaattatcttgtagttatgtcagttctgcatttcctccatggtacagcaaggtatacaaattattcagattgaagacaagactacaataatcaataatacaccatatcaaatattttataaaccacagctatctgtctgcaatccccattctggaaaggaggtaagcaaatcataacgattcttttgtctaagttttgataaagaaacaataaataggatcaacttctctttaacctatagcaaatgaaaagctaaccctgaatgtaggtaaagagaaattcacttatttttgttgtaattaaaaccatgaatgtcatggtcactgcttccaaggtaattaatgagcagaaatcctaccaagaaggaggccctgacacactgctggattagtcctgcctgtgccccatctgctcagaggctccagcctagtcctctagcatgctcactagactcctacaagcagagacatagtcatgaggactggctcctgggtcacatggaaaagcacatctgtctcacaggctgcagtgcctgggggagccatgcaggcaaaaggctagggcctaactgagccgtggatctgcgagcagtgagctctgtggttacaaggagaaaatgtggaaatgtactagctcatttatgttaacatcttgatggcagaatatatggaaaataaatctaagaatttcagttctttgaacaattaaaatgaatagttaatattttaagagaggagagatttttttttctctccattacatcttagatgttttccctttttttttttttaattatacttttaagttctgggatacatgtgtagaacatacaggtttgttacataggtatacatgtgccattgctgcacccatcaacccgtcatctacattaggtatttctttcttccctttcctccccctgcgacaggccctggtgtgtgatgtcccccctccctgtgcccatgtgttctgattgttcaactcccacttatgagtgagaacatgtggtgtttggttttctgttcctgtgttagtttgctgagaatgatggttttcagcttcatccatgtccctgaaaaggacatgaactcattcttttttatttctgcatagtgttctatgctgtatatgtgccacattttatttatccagtctatcattgatgggcatttgggttggttccaagtctttgctattgtaaatagtgctgcaataaacatacatgtgcatgtgtctttatagtagaatgatttatattcctttgggtatatacccagtaatgggattgctgggtcaaatggtatttctagttctagatccttgaggaattgccacactgtgttccaatggttggtttaatttacactcccaccaacagtgtaaaagtgttcctatttctccacatcctctccagcatctgttgtttcctgactttttaatgattgccattctaactggtatgagatggtatctcattgtcgtttttatttgcatttctctaatgaccagtgatgatgagttttttttcaggttttttgaccacgtaaatgtcttcttttgagaagtgtctgtgtatatcctttgcccactttctgatggggttggttggttttttcttgtaaatttgattaagtttcttgtagattctagatattagccctttgtcagatggatagactgcaaaaattttctttctgtaggttgcctgttcattctgatgatagtttcttttgctgtgcagaagctctctagtttaattagattccatttgtcagttttggcttttgttgccattgcttttggtgttttagtcatgaagtctttgcccatgcctatgtcctgaatggtattgcctaggttttcttctaggctttttatggttttaggtcttagtttaaatctttaatccatcttcagttaatttttgtataaggtgtaaggaagggatccagtttcagttttctgcatatggctagcgagttttcccaacaccatttattaaatagagaatcctttcctcattgcttgtttttgtcaggtttgtcaaagatcagatggttgtagatgtgtggtgttatttctgaggcctctgttctgttccattgttctatatatctgttttggtaccagtgtcatgctgttttggttactgtagccttgtaatacagtttgaagtcaggtagcgtgatgcccccagctttgttctttttgcttaggattgtcttggctatgcatgctcttttttggttctacatgaagtttaaagtagttttttctaattctgtgaagaaagtcaatggtagcttgatggggatagcattgaatctataaattactttgggcagtatggccattttcatgatactgattcttcctgtccatgagcatggaatgtttttccatttgtatgtgtcctctcctatttccttgagcagtggtacatagttctccttgaagaggtccttcacatcccttgtaagttggattcctaggtattttattctctttttagcaattgtgaatgggagttcactcatgatttggctctctgtttgtctgttattggtgtataggaattcttgtgatttttgcacattgattttgtatcctgagactttgccaaagttgcttatcaacttaaggagatttgggctgagttgatggggttttctaaatatataatcacgccatctgcaaacagagacaatttgacttcctcccttcctatttgaataccctttatttctttcttttgcctgattgccctggccagaacttccaacactatgttgaataggagtgctgagagagggcatccttgtcttgtgatggttttcaaagggaacgcttccagcttttgcccattcagtatgatattggctgtgggtttctcatgaatagctcttattagtttgagatatgttccatcaatacctagtttattgagtgtttttagcatgaaggggtgttgaattttatcaaaggccttttttgcatctattgagataatcacgtcgttttggtcattggttctgttcatgtgatggattacatttattgatttgtgtgtgttgaaccagtcgtgcatcccaggaataaagttgacttgatcttggtggttaagacttttaatgtgctgctggattcggtttgccagtattttattgagcattttcgcatcagtgttcatcagggatattggcttgaaattttctttttttgttgtgtctctgccaggttttggtatcaggatgatggtggcctcatgagatgagttaggtaggagtccctctttttctattgtttggaatagtttcagaaggaatgataccacctcctctttgtacctctgatagaatttggctgtgaatctgtctggtcctgcgcatttttggttggtaggctattaattactgtctctatttcagaacttgtttttgatctattcagcgatttgacttcttcctggtttagtcttaagagggtgtatgtgtccatgcattcatccatttcttctagattttctagtttattcgcatagaggtgtttatagtattctctgatggtagtttgtatttctgtgggatcagtggtgagctcccctttatcattttttattgtgtctgtttgagtcttctctcttttcttctttattggtctggccagcagtcttatctattttgttgatcttttcaaaaaaaaaaagcagctcctggtttcgttgatttttttttttttgaagagttttttatgtctttatctccttcagttctactctgatcttagttatttcttgtcttctgctagcttttgaatttttttgctcttgcttctctagttctgttaactgtgatgttagggtgtcaattttaggtcttttccactttttcctgtgggcatttggtgctataaatatccctctaaacactgctttagctgtgtctcagagattctggtatgttgtgtcttttttctcattggtttcaaagaacttatttatttctgccttaatttcattagttacccagtagtcattcaggagcaggttgttccatttccatgtagttgtgtggattttagtgagtttcttaatcctgagttctaattgcactgtggtctgagagactgtttgttatgatttctgttcttttgtatttgttgagtgttttacttccaattatgtggtgaattttagaataagtgctaggtggttctgagaagaatgtatattctgttgatttggggtggagagttctgtagatgtctattaggtcctcttggtccagagctgagtttaagtcctgaatatccttgttaattttctgtcttgttgagctaatattgacagtgggtgttaaagtctcccacaattatggtgtgggagtctaggtctccttataggtctctaagaacttgctttatgaatatggatgctcttgtattgggtgcatatatatttaggatagttagctctacttacattgatccctttaccattatgtaatgcccttctttgtcttttttgatctttgttggtttaaagtctgttttatcagagactaggattacaaccaccgttttttttttttttttttttttttttttttttttttttttgctttccatgtgcttggtaaatattcctccatctctttattttaagcctatgtgtgtctttgcacatgagatgggtctcctgaatacagcacactgataggtgttgactccttatccaatttgccagtctttgccttttaattggggcattagcccatttacatttaaagttaatattgttatgtgtgaatttgatcctgtcatcatgatgctagttggttattttgcccattagttggtgcagttttttcatagtgttaatggtctttacattttggtttgtttttgcagtgactggtaccagtttttcctttccatatttagtgcttcctttcaagagctcttgtaaggcagacctggtggtgacaaaatccctcagcatttgcttgtctgtaaaggattttatttcttcttcacttataaagcttagtttggctggatatgaaattctggattgaaacattttctttgagaatgttgaatattggcccccactctcttctggcttgtagagtttctcttggccgagagatccactgttagtctcatgggcttcccttgtgggtaactggatctttctgtctggctgcccttaacattttttccttcatttcaaccttggtgaatctgacgattaagtgtcttggggttgctcttcttgaggagtatctttatggtgttctctgtatttcctgaatttgaatgtcggcctgtcttgctgggttggggaagttctggataatatcctgaagtgtgttttccagcttggttccattctccccgtcacttttaggtacaccaatcaaatgtaggtttggtcttttcacatagtcccatatttcttggaggctttgttcgttccttttcattcttttttctctaatcttttcatgctttatttcattaagttggtcttcggtctctgatatcctttcttccacctgatcaattcggctattgatacttgtgtatgcttctcaaagttctcgtactgtgtttttcagctccatcaggtcatttatattcttctctacactggttatcctagttagcaattcatgtaaccttttatcgcggttcttagcttccttgcattgggttagagcatgatcctttagctcggaggactttgttattacccaccttctgaatctacttctgtcaatttgtcaaattcattctccatccagttttgttcccttgctggtgaggagttgtgatcctttggaggagaagaggcattctggtttttggaattttcagcctttttgtgctggtttttcctcatcttcatggatttatctacctttggtctttgatgctggtgaccttcagatggagtttttgcgtagttgtcctttttgttgatgttgatgctattgctttctgtttgttagttttccttctaacaatcaggcccctcttctgtaggtctgctagagttttctgggggtccaccccagaccctgtttgcctggatatcaccagcagagactccagaacagcaaagattgctgcctgctccttcctctggaagctttatcccagaggggcacccaccagatgccagttggagctctcctgtatgaggtgtctgtcaacccctgctgggaggtttctcctcatcaggaggctcgggggtcagggacccacttgaggaggcagtctgtcccttagcagagcttcagcactgtgctgggagatccactgctctcttcagagttggcagtcaggaacgtttaagtctgctgaagctgtgcccacagctgccccttcccccaggtgctctgtcccagggagatgggagtttgatctataagcccctgactagggctgctgcctttctttcagagatgccctgctcagagaggaggaatctagagaggcattctggctacagcggctttgcggggctgtggtgggctcttcccagtccgaactttctggaggctttgtttacactgtgagggagaaaccacctactcaaacctcagtaatggtggatgcccctcctcccaccaagctggagcatcccaagtcaacttcagactgctgtgctggcagtgagaatttcaagccagtggatcttagcctgctgggctccctgggggtgggatccactgagtaagaccacttggctccatggcttaagccccctttccaggggagtgaacgattctgtctcgctggcattccaggtgccactggggtatgaaaaaaaactcctgcagctagctcggtatctgcccaaatggccgcctggttttgtgcttgaaacccagggctcttgtggtgtaggcaccagaggcaatctcctggtctgtgggttgcaaagaccctgggaaaagcgtagtatctgggctagatagcaccatccctcacagcacagtccctcatggcttcctttggctaggggagagagttccctgatcccttgcgcttcccgggtgaggcgacaccccaccctgcttctgctcaccctccttgggctgcacccactgtctaaacagtcccagtgagatgagccacgtacctcagttggaaacgcagaaaccatccaccttctgtgttggtctcgctgggagctgcagaacggagctgttcctattcagccatcttgcccgggaattggtgtttttttcttttttttttttttgagatagagtctcgccctgtcacccagggtggagtgtaatggcatgatcttggctcacttcaacctctgcctcctgggttcaagcgattctcctgcctcagccttctgagtagctgggattacaggtgcccaccaccacacccagctaatttttgtatttttagtagagatggggtttcaccatgttggccaggctggtctcaaactcctgacctcgtgatccacctgcctcagcctcccaaattgctaggattacagacatgagccactggtacccagccgtaaggagaggtcttaagagaacttaaaaacagaaaatgttaagtggtatgctattgttttatactattgaaactgtcttataggaaagtattatctttctttacctttgtctgcacttttacctcctgctttcagctcctaaaaattatgttagattaatcaaataggataaaagtcttatacttttaagcttacaatgcattgtggtaaagtcagccctctgtctctgtaggttccatagttatggattcaaccaaacatagaccaaaaatattcaggaaaaaataaactaacaatacaacaatttttaaaatacacattttaaaatacaatataacaatcatttacatagcatttacatgttatcaagtattacaagtaatatagagatgatttaagttatactgtaggatggcacggttatatacaagtactacgccatttttgtataagggacttgagcatccgtggtattctcactgcttctaattatttcattaggacattctcatggggacaggattcataatattcccatgtccccaacccagcctctttctaaaaatacatagttatagatggtgtcttagaagatgtgctttacggggccaggcgtggtgactcacgcctgtaatcccagcactttgggaggccaaggtgggcggatcacttgaggtcaggagtttgagaccagccttggccaacatagcgaaaccccatctctactaaaaatacaaaaattagccgggcgtggtggcatgtgcctgtagtccctgctacttgggagactgaggcatgagaattgcttgaacccaggaggcagaggctgcagtgagccgagatggtgccactgcactcccgcctgcgtgatggagtgagactgtctcaaaaaaaaaaaagaaaagaaaagaagatatgctttaaaaagtttaattctgctgtattactgtagctaatgtgctctctgcatttttttttttttttttttttttttagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccaggtattttatgtttatataaatgtctgttcttctttgcttgtcagtctagctgttcatctagatgccaagagagatacaatggtcgcagggctccccatatgtaatattaggctttatttttaattacttctagacattgtatacagtgggtcaagtgttataatcacatatggcttgtcccagcatactacttaagggatttttccccatatggagcttacgctggggggaaatgatggtacttgtaccacagaatgtcattatatgaaaagatcatatgtatcatcatacaaatagcatcgtatgaaaagatcatatcataatgaaaaaattacctgttatgagttcttagcctccataaaattataagaaataagggttaaaatatgagcaagtcaagttggaagacctttttcttttcccatattttacttttacttcaaaatggaatttttctcaaaaaagtcattaagagagataacttagataaacacaagtcacagaagactctgttctgtggtcgttcctgcacgcaagttgctccaattaccgattaccagttatgcaaataacaaccacagactcaaaccagagacatataatggtttgttcatactggacttctattatgtggttgtcttgcatgtaaaatgtcccttctgcagctgtcaagaataacttagtatatataacagctacaaaagaaaacatattgtgcccttatgataagtaccttattttcatgattatgaatttgtagactttatttgagatttagcaatgctaactcttttgatgtaatattttaaaagacaagagagatttttttaatagtaatattttaaataagttattcataatggtaaggttctgttctccacacatccctccttcgttcacagtattcacaaaatccttgattttacaaacatttgtcatcttttacactgtagaggagtggttatccttacattctggttggagatgttaagcatagtgagtttaagggtgttttttgaaagctatatgaacttataataaataaaacattttttaaaaaacaaaatttgaaacaaaacaatttggaaattaagcttaaaattctgataattacagtataatttaatcttatctataaatactaagctagatattggacagaaagtaccatacttgagtcctggccctagccttcttggctatcaaaaagaagttatctgagtttggctcgcctagctgttttaaaattaggctgggaaaggaactttgctgtttatcgaagaactatactcttaaaatgaatttattttgtgctgtcccatctcctcatctatttccttccctcaatccaaccaacagcacacattagatggtgtgattaatgtgcttttaccaaatgctaatggaccattcactttgacatttcacacaaatacaatctttgggaagtactcacactggcaaatgagatggatggcaaatggaagctttttagagcattattgaccccttttagtcagctgagggccacatttggcaaattgtctgatttctttgattaattttggcaatcattctatgtaatttaggcttcagagtaatttcattttcctgcttcaaagaaatattctttgtggtagtctgtaatctaaataggaaaatttctctctcttcatcacagaaggcaacctttactcacacagctggttttctagctccaaataatacagctttgctcctgctaatcaaaatgtacattttttaaggtgtgatgggcttgtggaaattgacagcaaacattatcagcctgcctacctctagaaaaaaaagagcaagcacccaaattctctagtagtccttttaaaagaaggtcagctcttatttttattttttattttttttgatacagggtcttgctctgtcacccaggctcgagtgcagtggcacaaacacggctcactgcatcctcaacctcccaggcttaagccaacctcccaggctccagccatcctcctcccacctcagccttccaagtagctgggaccacaagtgtgcaccacagcacctggctaatttttgtattttgctgtagagatggggttttgcccttttgctgaggctgggcttgaactcctgggcttaagcaattctcctgccttggctcccaaagtgccgggattataggcgtgagccaccatgcacagcctaccaagcacttttaaggaagaagaaagtaccctgcctggcgaaggagtttaacacacatatgcatgggggaagaaaagaacaacaggaaatattagcacaaggttagctatagttctctctgggtgatagaattattttgtttgcctttaaatattttttcacattttatgaatattataaatatgttactgttatcagaaaaggaatctcccctgagttataaaacagatattttcgagttctgaatgttgcaaatctaaataaacatgttccagaggagagagcattcattttttttcctaaacatttctgtcatttgacttgattctcttccagggctatagtgctgacatatcaagaacacctcggagtgacttatttaaccctctcagaagaccctagtcctcgagtaattatccacaatagatgtccagtaaaaatgcttataaaggaaaacattaaaggtatgttttatactatcgaatttagataatactaaatgtgtattttttctgggattttttgatttagtagttacctgtgatcctgtgaaaaaaatatttaaataaaagcattaatgatctctttttgagaagtttcttttgccacattatgttctgtcccccaagtctctgtctttaagggctaattctgcatatgccttttttaaaatttcagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggtcagtgagccatgtgttcctgccaagacccaaagaaaaatgcccttttctgaggttttgtcagttgcctatttttaaacataattttctaaatgctgaacatcttttctctgtgtgagagaacatgtgtatccatttttacgtcctcattaagttataaattctcaaactcaagtatgtatctgcaaagtagactacacaatcattgactagagaggagcactagtaaaagcaggcccatcttggatctaatccaaggttgaaatggaaatcaaattgttaggcttatttagatagaacatagttcagctgtacagattttagtacagtcataatacaaatcctcttttgtgtgttattaggataaatatgtgtattttaaaattagtaattttaaaattagtaaaaccccacaaatataagtacagttttaaaaacctgagcagataaaatgtcttgatttgtttctgtcttcgtctggatgttagtgatactaattttgttgaaaatggcataagaacttagcatttcctttcttctggacttaaaatttaccatttgttagtgtataatttagtgacattaaatatatttatagtgttgtataaccatcaccactatttctgaaacttctttatcatttcaaacagaaactctgtacccactaagcaataattccccattctcccctcctccatcccctggtagctctcttcttctttgtctctgtctctatgaatttgcctgctctaagtatctcagataagtagaatcataaaatattcatcattttgtgtctggcttatttcacctagcataatgttctcaagtttcgttcatgttttagcatggatcagaacttcatttgtttttatgagtgaataatattgtgccatacttttttaaaaagttcttccacatttattagttcatctggtcttcacgacaagcttgtgaggtaggctactgtaatggttacaaaccatatattaaagttacaaatgcatttacggtagtaataataatggttatcattgaataatcacttacaccatacgaggcattgtgctaagcactttacattcattctcatctaaccttgacaacagccatacaagttagtgactatcatctccacggagggagaagtagaaactaagacctccagaagtaccttggtctaatttgcatgtagtggaagcaaaaggcctggaattttatccagttttgccagactgcaaagccggtgctctgagcacaatgcatgctgtttccttacatgaaaccccttggaacccctctttcccagtcctcctggtgcattttttctcatctctcaagatttcattaaagctcctgtgaagtgtatttgtgaaatgtggaatgactgatctgctaagggagagaaggaaaaagagaggggcctgagaagagcagtagctgtggaaactggtgaagggcctggctggagacaggggaagggatggttgagtgcactggagggccacactcaccctggagacctgcgtttgtagtggccacaaactactcaggggtgtgctttctatcagctgtgttcaggggctgaacagtgaaaacccgcgggatctgtgcagcctcaggagatgctcccagtctcattaatttacaaaataaatattgcaagcttctcaagggtctctgaactcccctgcatgggtttgaagatttttgaaatcttgcttatatttgactggggaattctttacgatagacattcttcctgtcaaaccttattttggggattcccattcactctaaatttcctcaaaactttgtagtcagggatacttcaaagctaagaggaggtgctctttccaacacccttatcatctgtggtttgaggacccagcagtctcatgttcccattaatcttttaggagctgtgtgccatatgtcctgcagaccgtggtttacttcctactctggaggaagatttgtttcagaccctcaccgacatctcctcagtaatatcccagggcatataaatcactgggaagcaaaaggagctgtgtcctctgatgaaaggaaggagcagtccttctggaggagggagtttgtcttccaggaaccttcctcagccattggtctgtgaatttcaaagctgacctaaacaagcaaaatcaaaacaccataaaatgcccattatgctgcaaggaagaaaactcctttaacttttttcagtcaagccctctgcttccattgtataaataagatagtctcgtgttgtagaattttgaaatggattgcatgaggaaatatgcacataggagttgtatactctcacagagtattctttggaccaacagttattgagaagacctgctaacatgtaggctgcagaataccgattgtgaagttgctgtgggctttctgtggttgaatccctggctcacacctagtcaggagacatctcatggttattcaaccagagacctgaaggtggcacctggtgctcatacccatgatttgatagttagtggtagcctgactttaggacaaaaacagtctttaggtgctcaataaataaagtcataaaagtaagtttacaccaataattttaagtcataattttgatcctaccaggaaaatagttcagactcctgtcatagtgtataggattttaatttctgatactctgaaaccacttttgtcagaattaggcaacattattttgaaaaagtcaaaataaggaacaaagaaaacatagtagttaccacttaactaccaacaacattgagaagcctgcttcattcattcagtcaacaaatactgagtttctaacatatgccagacattataacttggtactggcaccatgtaaaatatactgaacaaaaatgtagcacagcccctgccctcaagtttacctgtggaggagatagataataagcaagtaattgcacgggtagttgtattataagcactacaaagagctatgcaggaaaggtacagttgtgctatgtgggtgtacagcagacaagtttgagaggtcaaggagggtgtctcttactgagagaccttgcctctgtgccttcaaggtgaacaggcactccctaggcaagagagtagggaatctttccaggtagaaagagcaatgtgtttgaagcttcagtgttcagagggcacgtggtcctttcagggaactaaatgccagtgcggctgtagcgccaaatgacagagggtcggagagagggctggtgaggcgatgagagaccaaacctggcaaggccccgtaggtcctatcaaggattttggttttgatcttaagagtcatgggaagtcattgcattgtttatgaaaagtacttgctgagccactgaactgcaaagaatgagtagtttgaaccccagaaagtgaattaaaatgacccctttgcaggtaaattcccttctgaaaagatccagtaaattctcatgatctttgactcttagcagacattcgtagtcgggtcagtgtcactgctgtttcttcgcaaatggattgttttgtggggaggagagaatgacagtccttcatgtttctacagctctgtgccatttaccaagtgttttcacaggcacagtctccattcttttattcatttgttcaaacttttactgaggacctatcaggtgccaaaccctttgccctaaataaggcacaattcctgccttcaaagacttgaataaccaataaatgcagtaaagggaagataaagcctttgatcactgcaaaaattctaagggcaataagttttatgtctatttactgatgagagatttgaggcttaaagagtaatcagctaggtgacttgcaactaagcaggagcaagccggagcctaaatctgctcccatgtggtctagtcctgtttttcctacaccaggctcaagccactgtctgtcctctgaagtcttgccttggctacaaatagtagctgcctgaaagttcatcaaagcacaggttagaagagattttctgatctccgcattcacctaatgcaagaatcccttccatgacatctcaccccagaaggctcccagtgtaatagtcattacttatccagtggtggctatgagaaattttcttcttgtatcaatctgaaaactattactctgtagcatccattcattcatctttgttttgccctctgggacatcacagattgtttatttcccctcaaatacagcaacgctacaattatttgaaggcagctccaacatctttcctaagtgttcccttatccaggccaaacatttctggttccttgaatcattccttcagtaaatgcaatttccacacccatcaccacagttacccttgtgtgaacactctagtgtgttatgttcccttttaaaaatctggcagccggaattacacacagtattccaaatgtggtctaaccagctattaactccctatgcttccattaataaagtaaaagatagagttagctttttattaatgagttcagactgtctgttattattgaacttgtggtcaaccacatcccccaggtctttatcatatgacttgctatacagttgactttttgaacccaaagacaggactttacatttatcccaaataaattaagtcttgttgatattggcctagtccagcttgttgaaatcactttttaaaaaattgtgatgctgtcatctaacatattaagtattcctggtagctttatgtcatccatagatgtggtgagcgtgcattctacatgttcatccaggtcattaataaatatgttgaacaggacaagttcatggttgacatactgcagtgaatcattagacacttcccgaatgcatggggtcaatcagccagactccactctcatctagcccatgtttcttaaataagaaaatgcatctaaaatcacttttaaactatacagtataagatattatctacaagaatatcagaacatactttgttaagtgccttgatgaaccaggactcaaatgtgtaatctgtccatttggtgcagatcacacagaggtaaccttgaacactaaagcttaaagcagcaggtagtaattttcagagttatgtctaccctccaattcaggaatttttataaagaaaaaaagtcagtgcaggtgaatatctgatttataaaatgtgtaatgcaggtattttgacttcttgcttacttcgctcaccttcccagtactccagggcacagtcgaacagataccagcaagttggcactgacttctgaatgtctgctaggtaccctggtctagagtctcctctgtgtttacagtttgttctggctgagtcacaactgtttccaaagatactcaggagtagtgatttccctaagatgtttttcaagaagtatacagtaggaaaaattacatccagaatatccactgttttcttttcatctctgtccaatccttcctaccttgatcaacttagaaattcatcttcctttcttctcttggatatctaattcacctcatagctttagctactgcctgtcacccagtcactcccagaaattgatctccgggccccatattactcccagtgtacaaatctgtgcttctgcctacccactagacatgtcagcctgaaaatcctacaagcatctgaaatcaacacatctgaaaccaagatgatcatttttcttaccccaagccagcttcttctagagtctctgcatcagttaatgtcatcactgttttcccagtacaaaaaccataaataaaatggattcagataatattgaatgcctgttttatctcaagctctctaaaggtatagtcattagtccctgtcacatcctttaaaagtagatgctacccaaagctctgagaggtgaacttgctcaggataaatggtcctgggattcaaacctgggactgtgtggtttcccagcctaccttctgcctactgcttctcagtgtcttcctttctctctgatcctccacacatccagtaggccaccagcttctatcagaaatatctcagaaacgtctctggaatctgcccctttcttctgtgactggggtctgcttcaggcctttggttcatcatctccctcccagattttagccatagcgccttaataggtctctccattgtcagcctctccaacctcaagtctctctctgtaactaacccccaaatgattcctaagacacagactccagcccagagaagagaacccagtccaccaggttgcttaaaacagacctccacctgagaccaatcaggccccgtctcactcctgttccccctctacaggccagggctcaatcacctcttcccgcctttcaaagtctaagtctataattcttccatagcatggtttcctagttaagatactcttttacaaaccacatatatagagatatcagtagtacattttaaatttattccttcccaaaatgggagatgatattttttgtaagaaatgacttttagcccaaagtcagctgcacaaataaaatgcctaagtagcatattttcagatcagtttagacatatcaacttgcagcaaaagatgagtgtgatactatctgcaacttaaatgttcaaaagtagggagactaggtgcaatggcttatgcctataatcccaacacttcaggaggctgaggcaggagcatcacgtggggccaggagtttgagacccatctgggcaacatagcaagaacccctgtctctacagaaattaaaaaaaaaaaaaatcaccaagcgtggtggtgcacacctctattcccaactactcaggatgctaaggtgggaggatcacttgagcccagaagttggagactgccttgagctatgatcacgccacagcattccggcctggttaacagagcaaaacccgtctctattttttaaaaaaacaaaaaacttcccactattttctttgtcaccttgtaattaatttacttagtaaaattgttataattctaaaaaatttgttacatataaataatcattcaaataaagataactgagtacatagaaaagcagaagttatattaaaatgcttcttgttagtaattgtggtagaagatattgtactaagtagaaaccagtatccaggcctcaaatggttttcttagacctaacatatgtatgatggggctgagcacagagacttatgcctgtaatcccagcactttgggagattaagacaggcagattgcttgagcccaggagtttgagaccagcacgggcaacatggcaaaattctgttgctatgaaaaatacaaaacttagctggacatggtggcaaacgcctgtaatcccagctactcaggaggctgaggtgggaggatcacctgagcccagggaggcggaggttgcagtgagccatgatcgtgccacttcactccatcctgggtaacagagtgagactgagaccctctctcaaaaaataaatatgatagtgtcttgctgactgaagtgctctaacacagattcaaatggcaaaacggtgagtctcttagtatatgtcacctagagccttccatgccaccccacctcaccctactagtgaagaaagtaaaaagaaccaaatgatggcattgatcaggactggccgggttattctgtgataacaaacagctgaaaaaaaaatccccttggccatcagtcattaattatttttttccccacacacagaacaaatcttccccgcaaggttggaagcagtcactccatcacccttgaagtctagcacttctaagcgatgctcagtctgtatgtgatgccctttgatctggagacctatggaattacctgctccccctttccctgctgttttataggacagggtaacagtaataacccctccactgtggaagggggaagaatgagagacatacggcagtctcttgcctatggcagttctgaatgttttctgggcacatattgtggggtctataccctggcagcaagaaatcagctttcactgagcactgtttctaatcctgaaggagctcttaccattgtccttcaggttcctggctccaccttctgggagatcttccttggacacttgaagtttgtgtttcatctcacataatcacagtctcttttactccaggtttgtaagtatatagggcagtggtaatttctcaactcagtagacttcttacctatttggttccagaaaattccctgtgccaggaaccatattcatggtccttaagacacatttctttgcttacttgcttccttcctctctggatttaagagagcttctacaggaaagttatacccttgatttacatttttttccaagtcaatataacagttaagttttaacagtgagtgtgttgcctatagtcagtcttaaggctgagtgttaatctgccttcgtgttcagaggctaagtttagaccttgctatttgaggctttatcttagtctgttcaggctgctatatcaaaatacctcagactggtagcttataaacaacagaaacttattgtcacagttctggagtctaggaagtccaacatcagggtactggcagattcggtatctggtgaggacccacttcctagttcatggatgaccatcttttcactgtaacctcacatgatggaagggatgaggggctttctcaggctttttttttttttttttgagacggagtttcactcttgttgctcaggctggatggagtgcagtggcccggtctcggctcactgcaacctccgcctcccgggttcaagtgattctcctgcctcagcctcccgagtagctgggattacaggcacccgccaccatgcccagctaatttttgtatttttaggagagatgaggttttaccatgtgtcagtcaggctggtcccgaactcctgatctcaggcaatccgcccgcctcagcctcccgaagtgctaagattacaggcgtgagctaccgcccccggcctcaggcttcttttataaggacactaattgcatcccaaagaccctgccttctaatatcatcacattggggggctagaatttcagcgtatgaattttgggggaacacaaacattcagaccatagcaggtttaaaattatttctaactttgcaaggttctacatttctggaatctctctattatcttccatttttatttgcaacctggccaattctttcctgagctcatctcttcataaaacaaaacgtaatgttccagacacaggcaacagcagccaacataacaccactgatgcttggttttcagacctcatcttctagagctacagatttatgaagtttatgatctacctctcaagtcatctcaagcaacagttttactgaatatcttaccacttcaaaacatatatgcccatttttatagctttcaatatcgatttctactgtctgaccattaagccagggtctcctgttgtaggattttgctagaacactacttctatcaacaatatctatattagtagtataagctcagttatgctgcctatcataagcctagaacttacctcttgttcatgctaaatgcctagtgtgtgtcctcagggggttttgttctacatggtcactcagggacccaggttgagggaaagtccatcatctcgtatcttcccccttgtaactaaccaccccaaaacctactggcttaaaagaagaatgattaacaacttctcaagattctgaggaagtggccaagtgacttttctgcaggatgagcctgggatcactcgtgcatctgcattcacctagagagttggctgaggtatgggtgcagctgggaagtctgggtgtctctctcaccattctgtctgtcctccttaaggaggctagcccagggtggcaagcaggaaaaccccaataagcaagctgtatcaagcttcttacttgctgatgtcatgttagctgaagaaagtcgcatagccacgcccaatgtcagtatgggaaggtactacacaagggcatggatactgggatgtacaattcattgtgcaacagtcttccacagctatctagagcaggagtcaacaaatatttttttaaggtctggattgtaaatattttaggttttgcaggccttatgttttcccgacttctcaatagatggagagatatgtaagtaaatgagcatgttccaataaagccttattcacaatagcaggcagtggaccagatttggcccaccactgagctgtggaacataaagcccttatttattctctagaaggaatacatgtcaattctgcctttagcccattggccaaaactagtcacaagaccatatctaactgcaggggtggcggggagtataatcctgctctattcccagaaggagagaagagctagacatgtgtggacactagaagtcaatacagcagaagccacattgagaagatgtatgttcagatcatcagctttatctttattgagtacccggcactggttgtaagtactgaagaaaacacacacaaaaccattgccctcatggaacttacacagagtccatgatggtgaatacactgagagggagacgcattttatacacctgtggtctggaattgttagttgtcatctcattgtttgtgtacttggctttttcgccaactaggctgtgagcagtgcgagggtaggattgcatcttctctgtgcctgatgcagtgactaattctttgtaggcactctttaagtgtttgtcaagtaattgattgttcaaaccattagaccaagataaggatttactttggacttgtggggaacctggatatagatgcctaattcctgtatcactcaggtacctaactatctaacccctagagctgccatcatgcaaaaggctacaaggtgtgagttgtttctctaaatgtgaaaagacaaggatagactaaagtctgtgtttcttccattcatagcagtgagtgaaagggacaacaagcaaaaatttccctccagagtctaggttttttgccagaagaagtaccgtgaaagttcagattaatttgcttgccttcagaaggcccttggggcatttaacagaaaccatcaccttaccttaggtttattatcttagaaagtgtaagtatcctcatttcataatgcctgaaaatcacttagagaagagaacagtaaatatttctctattcgcatcccctccctctctcctctaaggggtcctgaagttatggacggtgacttaggaaaaggaatatgagatgggagcatgggacttaaaaaggtttctactgaatggataatttcatatctttcaacctagtaaagaaaagcaattgatttaccttatgtatcatacaaagggatggtgtttatagataggaatatttcttaaagaatatctcttttgttttagattcatgagctgagccatttttaagccattaattatgtttattctcaaattttattgtaagtttaatttttaccttggaacaaatagggcaaattcagaatacaagtcttttgaaaaagatatttttgcaaaacagtccatttgggaaacgtgttcatagagaatacagatacaacaaatggactccatttctgctgtcaagagatttacaatctaataattgggtcagacacataagtaactgtagtacagacaataatatttttgatcaaatagaaatatggttaaaattgttttagaatgtagaagtaggtgtcagtccagaagggaacagaaaaattaaggaatggctctatggagtaagctatcctttaagctgtatgcaccaggacatacaggcttttgaaaggacttatatggagaaaagtatattctaggcgtggtgagtagtgagtggcaggcaagggcctcagctgaagcagaggctgtaaaatgaaaaagaaggcagcagtggaagaaccaggaagagctggaggggctgggctgcagcaaggagcagagggagaaggcagagatgacatccaggtaacctgcatgctgaagatggtcagaaattctgaatttctgaagtccatgagaaagccattgcatgagaaagaagaccagtgaccttgaagttgcttccaaataactctctggctttctcctgtggttctgtgtacactctggtgcttcttcatgtgatcaaaattagaatatattcattgttggtcaagcaagaggccacctttgttccgtcatccaggaattttcagtatgtctgattttatttgctgccctaataataacatagggcccagacttggactgaattgatactgcaaatcatcagaaccagccttcccaagcataaggaggtttttgcccctaccctcaggtaatcctggctgtgaacatgatgttcttggagttgttttttaaatagccctgttctgttttcaaatatttacccatttaagcaactcactatttaatactgaaagggtgtttgttccactgtctggcacctggatcctgaggtagagcttttttctaggtcttagtccatattctcatggtagaaaaattaattttttactccgagcaaattaacttatatctaacattcttgttacgagttacatgaaagaccctagaggggttgtgatatgctcctaggtgggttttgaggtatgtttttgtgtccctagcccagaaggacacccctatagaagtaagtcaacacccaagagcctgaaagttgtttgcacattgcacttcaagtcccaagttttagtttttttcccacaaagatccatatgcacacatatagtgggccccatgtctgaactccagcccacacagagttacttgccagttccaaagaagcagagaatgaagatactcatgccccatcatccatcatttttttctatgaaccttacagctgaatattgaaaaatctggttttgatcttttgggtattttttttcatttcaagtcaactgaatagcccgtacacatggatataaagaaatataaccaggaattgtttgtggtattgaatcagaactggagacatttgaagtcaagccacttcaatagtgtttcttatttctttttaatcagattttgaatattctttctgcaggttgtgttcctgactggctttggctatgtgtatgtggatgttgtacatcagtgtggcacagtcttcatcactgtggccccagaaggaaaagcaggacctattttaaccaataccaacaggtaggtttaattattttcccagtgacaacatagtaagtgttactgttacaaagttgtaaacttagtatttatctttgtcatctccacataatgtattaaagcttttggttaattatcatgtaatccataaaaaatatggttattagcactaaatcatcccttcaataggtagcaataaaccgtctttcctagataccacttgcactccttctgtggtagggttaacaaactgatttacaaactatgcatcttggaatcataccactattattagcatgaaatgcacattaatacctctgtgtctgcatgacagtgtagtaattaataataaaacttagcaattagagctacatcaaatataaatacgcctcttagagccatattttccaccccccactttgacctgaatgttgccatcaggttttaaaaacatgaaatagacaaagagttaatatccttaatttaaaagaattcacataattcaataggaataatataaagatggccttacagaaacaaaaataggggcaataggcatgaacagaaaattctaagaagaggaaatataagtaatcaaagaaatgctaatttatcaaattaacaatgatgttgtatcatatacagtcctggtgaaagtataaattggtactatttccaatttataagcactttggtaatacatattaagagctttaaaatccttttggcttagaaattccacttttaagtgtgttaggagtttcagagttaaggaaatggagaagtgggcaaagatatacacagagagatgtacacagtgagagatatcacacagttaattacaatggcaaaatattcaaagtaaaaatgcccatccatagggaaatagatgatacataattgtactataaatgttacaactgcaaaaagtagatctcaaagaattttaatggaatagaaaatgcatattataatctaaaataaaacaagtagaatataatattgaatatatatgatcctagttatgtgttatctgtacatacatacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacctacataagtacgcatgtatgtacttatacatacatacataagtacgcatgtatgtacttatacatacataagtacgcatgtatgtacttatacatacataagtacgcatgtatgtacttatacatacatacataagtacgcatgtatgtacttatacatacatacataagtacgcatgtatgtacttatacatacacagaaaacattcctagaaataagactgaaaagaaaaaaactcaaaattggtaacagatgtggggttaatgagttatttaatatgtaattattatttgatttctgtattttgattatttataatagcatttattttatgatcagaaaaaataacttaatattaaaatataaataccaccaactttcatacgtttgtttaaatctttcttttaaaaagctcattgcagccaggtgtggtggctcacacctgtaatcccagcactttgggaggccgaggtgggtggatcacctgaggtcaggagtttgagatcagcctggccaacatggcgaaaccctgtctctactaacagtacaaaaattagccaggcttggtggtaggcacctgtaatcccagctcttcaagaggctgaggcaagagaatcgcttgaacctgggaggcggaggttgtagtgagccaagatcatgccactgcactccagcctgggcgacagagcgagactccatcttggaaaaaaaacaaaacaaaacaacaacaaaaaaagtttattgcttctcatatatggttaagaactcattaatttggactctgctaatttgaatttataatatttcaaacaatgttggatagaatgttttctttgcccaaaagtgttcataaaaaattaatagcataacaaaattgaagacgaacttttaactagtatagcacaaaatttcgggtttattcaacaatttcagaaacattttatctagggcataaatgttaataacaatagaagcaaactttcatgagaaaggtacaagtatttcttggaatttcattcattcattcaacaaatgtttttcaagggcttattggatgcctagcatgggatgaggatacatccataaataaaaaggcccaatcccttccctagagaagatgactttctcctcataggcatggaattgggcaaggtgatggggggtgtagagagtaaacctaaaaagaaaggaaatgttatggtgcagtagaaggtcagcattctacagggatgaaaacagagctcagtaagaggggctggaagtgccagggccaagggactgggaaagtgtagttttaaacaaattggtgtaggtaagctgcactgagaagttgatgtttgggcggagactggaaagcagtagggggttagtaatgtgactatctgaaggaagaacttcccaggcagagggcacagccagttcaaaggcctgcaacaacatgcctggcatcaaggaggagcagggaagaggctgttgtgggcccagtggagggggtggaagtggaagtagcagtgcatgaggtccaggaggtaagagctagaaggagggagacctcatgggccattgaagggcttagctttaattctaagtgaaatgaggaactcattggatcatttttgaacatagaagtgacaccctgtgacttaaatttctagaagatcattggccgctttgttgaagtagactgtagagaaacaagggcacaagcaagcagggagactagttaggagaggattacagttgctcacattagagacactgatggcttagactacagtggtgtcagtggaagtggcagaaagagtcagattctggatatgcttctaaggaaaagtcaatgggattttcctaatacattgagtaatggctaaaaatagaggcatcaaggatgacaccgaaatttttggtctgagcaactggtaggatatggctgccattaactaagatgagagagactatctgcagatttaggaggaaagatcaagagattggttatagacatgataagctgagatgtcatttagacatctaagtgactgtgtggataggtagtttgatacacaagattggagttcagtagggagctccaggataagtatatactttggaagccatcaacatatagatggtatttcaggtcataagactggatgagatccccaaggaagtcagtgaagatgggggtgagaagaggaccaagggctgagccctaggcactttaagaggtcagggagaggaagagggatctgcataaataactgaggtcagagaagtagaagagctgagagaagacaggaaagaaaagtatttccaggaggagggagttgtcagcaatgtcatatgttgttagtatgtcgaataagcaaaaaactgaaagtccatcatttgatgtagccaaatggaagtcactgatgacgagttgttttattaggctggggatggaggcacaaaaggctgcttagagcaagccttaaagagcagggaaggagaggagttggagacagtgtgtatagaacacactttagagtttctgtgtagagaggatcagaaaaatgagtggtagctaagggagagagtggagtcatgagggattttttgagctgagagatgacagcatgtttacaagctgctagtaatgaagaaaaagatgatggaggaaaggggtgtgagttgctggagggatgtctttgagtaggtgagagcagagtgacttggtgcactttggagaggggttcacctgagacagaagcaagggtggttccgccccagaaatggagatggagaagagccaagcatggactcaggcacggttgatgggcagttgtggcaggaattcctgctaagttttcttctgctcacatcactttttcaatttagggagtctcagttactttattatctctttctgtcttgtgatcatcatgatagagaattagtacacaaagactagagggattttggggtaaaaatctggtgttgataagggaaacataaggaaacatgacaagagcttgtaatagtcccattgggaacatttcccaatactgttggagtgtgactgactccgtccagacacaatgtactgaaagttgagttcttatttgtttcttatgagaatctgatgtcccatcaggaggtatttaatagggtactgtcaataaaaaagaaagaagagagaaagaaaaggtgagtggggggactaatgttcttgtccctttctcctctagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggtaagaacacaagctgagggtctgtgatgagctagagcccgggtagaaatgacacgcttgggggtagcacctcatttcaagacctaaagaagcaattggcaagaggtgacacacctgagctctacagttacacagaactggatctaaatctagagcctgccactgttagctgtaagactttgggcaagttattgaaccttcctgagtctccatttcctcatcgataaaatggctttgaagatttctgagaggatcagatgaaagtacgtgaggtacccagcattttgcttgccactcaataaacattcaagcagtagtagctgttctgtaacttagaattttagttcagtttagcacacacttttttttagcaacttgcaggcacagagccctttcttagcacactagagcaactaggaaaactagcccaggtcttcagtccctcggcctaaaaggagtccagttctcgtttattttcttcattgctatttatgaatagcggtaggtgagaaattcagaggatttgtgtgcttgtaagatgcacattgagccctctatctacccagtgctgcactgcctgtctatatagctggcaaagggaaggctgtgagtgtgtcagcctctccacagacctgagctcaaagagaaggaatggcccatccactctctggggccaggcaggtggcctcttgcaggctgagggctgctgtttctcagggactcagtgggaaaagtaaggattcccttttcagtctggctggaaaagtctgcagggggtggtttgaacatgcatacaaaattttatagagggactactgtgtactagcaactggtggatagcaggcgcagtggctcacacctgtaatcccagcactttgggaggctgaggtgggaggatcacttgagcacgggagttcaagaccagcttggccaactggtgaaaccttgtctctataaaaaattaaagtttaaaaaattacccaggtgtggtgtcgtgcacctgtagtcccagctactactgaggctgaggtgggaggattgctcgagcccaggactttgaggctacagtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatcttactttctgaaagtaacagaggagagagcctttgttctatcctctttgtaaagttgtactttgtgaatgcgttcccatgtaagattaagattgcagcagtaaacgacctgtgttattgccatattggtcagattacattttctccataatgaaattcatagacttactagggttatctagactcttttataaaagataacaacaagatcagggagagggtcctgccagacctgttgtcttgatagcttgcacaacaatgaagaaaacatttccctattgctaaaaactcatttaaaaataagcagtccacatttcaagtttaatagatgggtgtatttataaacagttccagaaactttcccttcaggcagcctttgctttttcacataagaagcaggcacgtaggttactgagctccaatctgaggcctggcaaggacgaaggctcccattcagtctctgcacgacgcagcagtgcagtaagcagcagggaaactctacctgtggcaccaagtaacgggccctgcagcccgtgtgctaaaaacgagctctctttgttttggtttatatttttaatgagctttcacaagaacattctatttgaattttatagaattcacccaaaaatcctctaagctgccgttccaatctcactgtataccaagataagggattctaatatagagggccaagttttcagagcctgttggaaactctgtcactaaaaatctatggacaatctgaagaccatctgaaagaaagcagtgattgaaggagtaggaaatgggaagatgctggaggctccagactcccaggttagcatccttgtcgagggaagggagagagctggctgcaggtgggcaagttgcccacccacatctcacttgagtcagagtgcccctgcctgtcatggaaaacaccctgacctcatttctagggaagttgtggtatcaacttgaagaggttttaaaaataaagaaacaggccgggcgcagtggctcacgcctgtaatcccagcactttgggaggccgaggtgggcgaattgcctgtgctcaggagttcaagaccagcctgggcaacatggtgaaaccctgtctctactaaaatacaaaaaattagccaggtgtgggggcatgcacctgtagtcccagctacttgggaggctgaggcaggtgaattgcttgaacctgggaggcagaggttgcagtgagccaagactgcaccactgcactccaacctggacaacagagcgagactccatctccaaaaacataaaaaatatttaaaaattaaacaactaaaaataaaaaagtatgggtgggagaggcagaataaaaataaatagtaattggaaatcagtaactgaccctatctgaaggaaagcatgtggtctttatcctgaggcccctctctaacccaaagtctcagtttgttgggagccaggcagactcccttcttcaaccaatttccaaacgactgagcaaaagatagatttgcttttgaagggcaataaaggagtacccttggatctgtctgcccttttctgaccagctaagatgtcactgagatgtagctctggcctacacatagcccttctatcaggcagtggcttcaggattcaagggttccaaccccacgacaggggaggacctgccactggcaggagcaagaggccgaggcggattcccactccctctctacgcccacggcaccgacctgaacaggcctgtcgtgggggacactgcttggccatagctgctactcctttcttttatacatggactccgtggagagatggggaattaagatgtttctagaccaaccttctgccgttaggtacacccttacagccattcagggctaaagggaatctgctgtttctttacctccagagaaggccctccatggaggaatattccacagcctccccagctccctcgcctactctttgcagcctgagctcacagaagaaagaggtgggtgagcttcagaattaggaaaacctgggttggaaacccagcccacaggtggatcatccaggggactgtgagcagttggcttagtctccaagcctcagtctcctccttttcctgcctgtgaggccgtggaagcagtaccaccatgttgcattcacctctgcctcctgtgcctggtccattccctgacccagacagcagctcagtcaccagttagcctgcactgatttgaagggagagaatacttttcttgcagttaccgtgagaattaaatgtgttgaatgcctggcatccatagggcctctcatttgtaatctttatcttccagaaattattccctcctttgccctaaaccctagtgttatcatcctaacgttccagagaagggaggagggctcaaaatttaagagcgtccctctcttcgtgggctgggcatgggattcttcgggaccttggcgtggctgttgtaccctcaccttcctgatcccctcagatcgctgagctgaggatctctgtcacaggactgtcctcctcttcagagcctgctggtgaaggagggatggctcccacccagtcctgtccccacagccttcccattaccgggctctgagcaccaggctggggaggtcagtggcttcccggagaaagctgtcttttcagactcctcctctcctgggccctcacttgcccctccaattcttggggcctacagccccaaatccccaccccagagagccagggtaagggcagtgcctgccagactccacgcacagccgcgttcccatggggcagcagcggctgagtggcaggccagcttctggccagcccaagcttcaggaggaaaccagatccaaagctgccctcctgggacatgcacaagggaacactcccctctcactaacctcatcagaatgtccctgtcacagagttcaagaccagcctggcctacatggtgaatccccatctctactaaaaatacaaaatcagccaggcgtggtggcatgtgcctgtaatctcagctgcttgggaggctgaggcagaagaatcgcttgaacccaggagtcagaggttgcagtgagccgagattgcaccactgcactccagcctgggtgacagagtgagactcgatctcaaaaaaaaaaaatgtccctgtctctggtgtttacataaccggagcaggggttgaagggtccaagacatttgtctgggtctagctctgctccaaagggaagcactcaactcagtaggattgggaaagattaaaaacaacccctccattcttgtcagaagtttgcatcccctttgcgacatgccattgagcatctggccgcccctggccaggcatctcctcctatcctggtgcctccgctgtcccggggaggctttagagagaacctcccacctgcaaacacctgcaacccaagaaggcgcccttcctcaggtggtagcagagtgcatccccgccacatggacccccgttagcaggaatatgggaggcttgggcaaggcagtcatattaaagccatttgtggggccgtcagaggatcactttgatttataaagtatgaaagtttgccatttatgaattcacagagaatgacttatttcccttattttcttccaaagaaacagattactttcccaattctagtgtgaaaaatgaattgcagggaaaatgggtcactttttcacaaatgttgaaagttctgcatttgaggtttcaatcaccccttccctcttgtgcgttgcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtagcgggttccgttccttgtaataatgccttcactccttccctttttttttttttttaaagaatgtgctaaagttttaaatgcattcagattgcctctagctttgtttggccttttagcttgcagtgagagtttgggtttgtaacaaagctcatatataatgtcttatgttttgaacagatcactacttgcctctggtgtgtgaaaatgtttcagaaacttcagaattttaagcctcccattgggaaaacaaggattggctcaaatgttatttcatgtgataaacacagaaatattaaaggtgttcaggatttctgctaaacatcagaaaccctacactgtgttgcctcatcatatttttttaaatgtagatacagttgtcataactttcttaaggatatggatacattctgacatggaagcggatttgggggtgaaacagccaacttttctctagcacgccacgtaaacagtgccatcttgtggcccagacaggtcatcgggcatggaggccaaagtgcttcccgcaaggacagtgttttagttttatctgtgtgtgtgtgcttgatgttattttggtcaggttggcagagacttgggaactaacaagggccatctgagtccccttttcttctcagcaggaggcaaggaaaacagggcaaagggcttcttcccgtaaaaggcatctgactataggccataggacaggtctgtgaaagtctctggaaggcctcaaaagaagacttgatcttgaaataggagaatccatgatccatagagcgggtgagggactgtgggtgggagggctggcaagagaacagccagagtcataaaaacaaattccacggacaatgaaaaggacactcccccaggcctcaaatcatctgggaggactgggggctgagctgcagaaactcaccccatgagtcactggcagactgctcactcttgacactggaatctctgtggttctgttgtttttatgttaaaataagacaactaacacctgctaaattgaacctcagtggtattttcagcctactgactcactgaatgttttttacacttgttcttttcttctcttagcaaaatctttttggtttgttggcatccctatgtgtgtgcgcacacagatatttttcttttcagattactggtaaagatgcagctgcaaaaacgacattgagcatttcttcctgaaactggacctgcaataacagatgagctagtttgttagtgtccagatctgtccatgaaagtcgctcagtttcgctcactaagatgtgtgcagacctgctagaggaattgtggctattgtgagcaaatgctgaaatagcccttcttaggaaaaccagacagattcacggctctcacatgatttactccctttattcccctcactggtttttcagttaacatcctgaatatcaaaattgcacatattctccatggcacaataattacatcctcagaatggcaaatgataaggtttagtatctccccctttgttatgactgaagttatatggagggaataaaatttattcctaaagctgaagtatttctttataatctttctaaaacttagcaacataactttaccctttaaaatcacagcaggcagattttaaccttcaaaattgggcctcagtgaaggcatcaatactgttttaaccaaaccttgacaaattaaattatagtgaaggatagtttcatatgaaactctaggctgtgttctgcacctgcgattcttaccctttgaagagtgtcatcacccctgtgggcaagtgttcctctttacctcattttctttttcattttattgtatcttatcttatttgagacaaggtctcactctgccactcaggctggagtgcagtggtgcaattgcagctcactgcagccttgacgtcctgggcttaggcgatcctcccacctcagccccctgagtagctgagactacaggtgtgcaccaccacacccagctaattttttaacttttcatagagacagggttttgccatgttgcccaggctggtctcgaactgctaggctcaagcaatcctcctgcgctggcctcccacagtgctgggattacaggcgtgagccaccaccccagttgtttacctcttttcttaaggctctttcttcaaattgcctgagagggagccaccatcacttgccactgggcatgtccaggaggggccacaggtgctcccgctgcctctgaaactactgccttggggtccatcatgtatgcgacaaggaggctaaccccatgctcttgttccctcaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtaaggggctgcggggcctcccacctgtctgtactccagcaggctgagatgcagggtctcccaggactgggcaacttcgccttctgcctgggaatgaccaggaaatgctcagagaaggtaaggcacttgctctgagttctacagtgcgtcccgccgggggctcacctgcacagccgcacatgcagcgcctgtgtttgctttgtgcatgaaatgtatcttgggcctcactgaagttcttaaaagaaatcctaatttgataggacctgctctaagcatagtggtgtctgcaagaggacagcagcatccagctgttggctttctgaagaacgtgatgggcaacgcttccgaagcactggctccctcactcccacacatgctgagccgcttcttttgtttgagaaacactagagcaacatgcaaatgtcacgtaaacttcagtgaggagcccactttgtcctttacttttttgagatcagcctgattcagagtaattattgtttgtagagcagccagatggtatagttagaggtgaagattgctctgcatatttcaaaatattacaaatgtttgaaaataagttgctttaaaaaatttatgaaaaggaagcttcagagctaaaagtttgcagggcaggattttcaaggatttttttgtttatttgtttgcaaaagaatttaaaactgtattgcttggcaatgtgccttccgcgcatctgaggaagtgtgtgcctcccagagatcaaagtgacccaaagcagtgcagagcaaagggtagaaaagatgagtttgaaaggactcgccctctctctgatcttcagttctctacagaactcctagattggcaactgcagctagctgaggctctgggaggaagtggtaaaatggtacaagttcaggttaagttgctggaaattatataggtaaaaacattcagtggtgtggggcactgtcatttgataatatgtggaaactgggaagctggtgacctgtggtaaacaagctgggtaagggagcaaccttcttgcttaactcagtaacccaaaggtgatggtgactcctttggggaaggtggtgtggcagtggaccctgccctcagaagccccagaccttgggctagggtgttcaagtcctttctttgtgacctcaggcaagttctcctctgaacctgagtttctcttttgtatattgggcctggtgataccattgttagaagtaacagtgggtagttatatggcagccaccatgctcatgtttggtaaacagaacctatcattatcatagtatggtagcaaatgaactgtaagagttgcctggtttccaagagtgcctcagcaaaaagaaatatttgagcaacggcagtaatattttcacttaatccaatggattaagtggctgtaaccagaggaagtgacaatgaggttatattgaggatctcaaggtcattgttttgcaattcgggacctgttgatgctattaattggagacttaagtaccactactctgctccaccccagcccttataggagcttctaggcaaagagagagagagagacccacccctgggctggctggtgtgtggctgtctccaccccaacccccgactcccttcctgcccgagggttccagtctcttcccagtcagagaaaccccagccaatgctccgttttcagtgtgtaagattgtacctgatgggaaaaatcagttgtgtgaggagtcacaaatcagccctgatgaggtcatctttctgggcgtgggtcctgttgaccgggtaagtcataatgctctgatctttggtgtagtcattgtgtcttgcatatccttatccatgtgagggaattcatttttggaaactgcagtgggctcatggggtctttctgcatatctggtaatttccagaagattattaattcttggggtaacataagcctcctctgtagatgctggctgcacctgccaacactggccagccccagtcccagcccagctcacaccctgagcagtgtgtccatgtcttgactctgcagagttcacagtgggcatctcaagcttggctcaaaccagcttcctttcctgtaagacttcaaggacttcctttgtttcatgtactctttgggttatctcaaaatgtctggtcctagaactaccaggtgtgtggcaagaagaacaaagagcggagtacagcaaactgaaatctcctcactttggaaagttatagattggccaccatttaattcttccccagaaatggtgtttgaaattgccacatacaatgcagtgcctaattgaagttagagccattatcacataataatttgaaatccaggccgggtacatggctcacacttgtaatcctagcactttgggaagccaaagcaagtggattgcttgagcccaggagttcgagatcagcttgggcaatgtggcaaaaccccatctctacaaaaataaaatgaaatacaaaaattagccaggcatggtggcacatccctgtgggcccagctactcaggaggctgaggtggatcacttgagcccaggaggtcaaggctgcagtgagctgagattacaccactgcactccagcctggtggacagagtgagaccttgtctcaaaataataatagtaataataatagttttaaacccatgccagtgaaatagatattctagttgctcagtttcttcaataaaaagacagaaacgttaaggacccagttaataaaaatatattaaaggaaaagtttagagttggcaaagcgttttcaaaggtgtcatcttatttgatcttcacaacccttcacaacttcataacccttcatagcttcacaactttggatgaggtaaagcgacttagccaggtcaaacctccagcaaggacaggagcctgggcctttccaccatgtcgcctacccctgtggggctccaggcctggaaacaatcaggatgtggggagactgaacaattgcaagttccagtgtaggaaaaacacatttcccccaaatgtttacgggttcggcgggccttcttgactctgcttcaccctcatggggacactatggagcattatgaggcccttgaaaattaaagcaagtctgcagctccatgcccagccgcactgccccaggtcagcagggaaaagtgtctgctggctgagagatgctgccgaggcctttggatgagctccatgacagttttccaagagcaacggcttttggaaaaactccgtttagcctgcagtattggcatcagccttgcccacatttaccagatctgttccccaacaccctcactttctactacactctggagcctgcactgagaaaggacgtgcagctccgcatcacagctgcattctgcgtttcctcccaaacctgatgccttctcatgaacaccaaagctaggatgtcaagaattgcttctctgacccccacttcttttgggatgcttcctggtttgtgatgcgctgctggattccccagagaccacctcctctctcttcatgggcactcttggctatgccatctggaatcccaacaaaacaggcctccgccaggtgaaatcagaaaagtcccctccgagggagtgactcaagagttgcacatcccaagagacagcccttaagagtcatccctccaataccaccatctgccattagcagactggtgtgtattatagtcagtgcggaatttaggaatgactggcaaagtgcttccttgttggtttgctcgtctgttctggtcaaaaaaaagaagcgctgagctggaatgtgcagtacactctatgggtctcgttactttctggaagggcgagctgtggcgtggtatcccattttatgcctgtccttctgatagtgtgacaaaaaattgccagaaacaaaattacaccacatggtaaaggcagcatcaaaacagacacatcaccaggaacttccatagcccagtgaccaagtagtttctgcccaaggcctaggagcaagtcacagaaagaggtaagggaaggcctggtggtttcctgctccacaatgaaggctttcctcctcctgcgccttccaaggcacaacaggcaatagctcctgtgtcctgcggggtgcagcactcactcagtcctggaaacccctcccagtcacgctcttctctcttcactggcttcatcagatcacagccatctccatgtggtcgcccaccccacgggcctgaggccagcagacaagtcttgggatcagtttccactcctgaaagccttcgagcagagtttaagtctatgacagtccataatttaccagttgtgggatttagctggatatacttcagaggagagccattccaggctctcagagaggctgcctctctcaaagcagggctgcagggaccatgaagtggctgctggtctcttagcctctctgttctccagcttgtgagcacagaggtagataaggcacctggtggctggtgaggtgttggtgtgtgtgacaggccagctttccccctcaaaggtctgctgctgagcccagggcaggtggttccacagctccctctctgactctcagaatctaacaccttgtcatgggactcaggctttccacttttggggggctgcccaaatagtcttatctgtcaaagccacagtaaccgaagccttcactgtggccagagaaaacggaagagcagaacagagggggcctcacctgatacctgcatgtgctggagcaggtggctgtcagcaccctgtgcgggtgaccgcagctggcccaggccccactctttgatttgatgctgttcactttgataatctgctgaggtgactggaagagaagacccagggttcctgcctgtccctcagtgtggccactatgacttctgatcttccaaatggagtggagcatcaacggcaaatgaggggtgctcccagctgagcgccaggcctgactgtctgtggtactaaaagagtgaccctcactcttgatagctggggtggcctgggcctgccgggagcagcttcctctgctcactcttggcatttctgtagaaggtttggcagcacgactctaggctgggaaacaggtctgttgcctcaggtcattctgaatctgtcaatgcataaacttaaatgtctctgtcaaaacctagaggaaaggagtccatgaagagcattccctttacaattgacgtgatatgcactaaaatttctaccaggggccagagcattttcatcactcctagcagttttgaattgaaaacagagaattctgtcaagaattgtaaagaaattttcccttctttctgagatagggagccctccactccatcacgaaaaaaaaatcagaatggtaagacttttctagctctcactgttggcctctcaaagcaggagtagcaaaggggccgtatccacaggactgcctgaggggctcctttcatctgtagctgcctcaggctcagtgcaggagatggatgccctgtgctacagctgtgggagcagagctccaaggggttttggtcgctattctaagtgaggagtaagtggccaaacctcaattccagtgagagagaaaggttttccaagattggcaaagaggaagagcctgttttataaatgggataagcgagtatcttggtggttaagagctatgctgtgactcaaactctctgtacacttaacagctgtgtgaccttgggaaaaaactccttaacctctgtgcctcagtgtccgtatttggataaaaacaatgtatgactcctaggaatatgaggatcaaatgatctcatacaaataaagctcttagcacagtccccagacctagtaagcattcaagatagattacctataatccaaataataattactatatcaataattactcttaagtattaatactactaaattatgactgttatcattattatcaaaagtggagagttagaaaggggctaaccccttccagtttttcatcctcatgaatcagtgcaaatgtattgggctgaacagtctttctctgctcctgaggaactgttagctcctctctctcaactttgttgcctgacttctgaggaaagatgtatggatgacactctgaatagcctgacaggtttgttaaattctgaactaaacttcacagatcctgactgtgtggaccaaactccgtctgaacattgtattttgatgacgataataaatgtctactgcccttggtgtacttagataactggtaaacaaatgggtagtaaagacctttataatgagggtggggactcattttcaatccagataaaactgtgttccagatggagcctttcattttccgaggattttaagcctctgtccttactgagggcttttgttattccaggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtaagtcggtggaaaacccatcaggccaacccagacgttactgatttgcatgcttataccaagggttccctaagatagtgtaacctttcacatggcagacagtggctatctttcttacctctctatgcttatttacacagagtagaattttactactaataataaaaccatagaatcaggaaaccagttactagtttcagtctatatgtcgtagaatctttttacagtacacttgatagactgtaacgaaaagtaaccagtttagaggttgagggcagaatggagaatacagcagagaaaagaattaagactttttcctatgataaatgtggaaggagagagaggctgtgggaagataactctaagaagcagtagagaatgagacagagtgtggatgtgcacatgggtctttgggtgtgggtggccttctcacccacagaggacatcctgcccctcgcagccaggctgggcagaaacaaagggtctgcaaccagaagccctttcacaaggcagacagctgggaagtgcgtggcgcatggcagtacctgcacttggatggggcgtgccggggcctctccccgtgcagccgcatgcacacacgagtaatgggtgcctgtgaaaggaagcacctcctcccaggcttattttctgtgttcttggcagagcacattcaagtgactttccataaacctgtggctggaactgttaccattttacctaaaattggtgtcatcattttggtaatgaagcaggttgtctagctagtatcacaaacgacagaagcgccctcccgtttgtcagacatgtgagcacactgtgtctgcatccgcatctggccataaagcccatgggatgtgtttctagggaggcatcctgctcctcagcaggcctgacaagaggcagccagatcggggcataaaaacaaacagcgtctgaaaggaagggagtggagatgaatgagtgcccacacttcaggcagccatccggagagcatccttaagagaccacacagacgccagcatgtgttcctcttcgctttcccctcctcgcccgcctcatttccctctccttctgtgaatgacatgttcactcacagggaaactgtcaataagatgtgctataacctataagtgagaaaagttacactctcccttatgatagggactccagtgaggtaaagtgaagtcatacttcataaattcttttggttttgaaaatgccattgtccctcaccgtgtttcccagggctgaagaatgctcccttatgtaagaggatcttagagcagagcttcacatggccgttttggtttccatcactcttgtaaaacttttattaccgaactgaaggttttaaaaccactaactcttagtctaatgactatgcgtcgtttgtaaacatttacaagccctcagaaagcacacatgctgtaccatctttggtgctggagagtctatgtaaaggcctatgtggctgctgctgggtgccctcatttggtgctggcaccagggagagcatgtcataaaccaggggccccaagcgtgctcataaatgtatatggattcgtgtttaacagccggattaagtcgcttagcatttaagtagtgtatctaggcaaagggtgtgcctttgtatatatctgtgtgttttttattttttgactagccttagcacagatacagaagtattaaggaagttaactaacaatctagacttttttttttagacacagggttttgctgtcacccaggctgacattcagtgacacaatcatagctcactgcagcctccaactcctgggctcaagtgatcctcccacctcagcctctggagtagctaggactacaggcatgcaccactatttattttttgtagagatgggggtctcactttgtttcccaggctggtctctaactctgactcaagcaatcctcccaccttgatttgacctcccaaagttctaggattacatgcatgagccaccacaccagacctatctagacttttttaacacatcaattaaaatgatgtctaggctattgttcatgaccagctactttcggtgtttttgcttcctctaattgctagtctatgcttggactgtgtaacacattcatattttagtttgttactaatgcaagatcaccaaggttaagagcattgtaatgtttaatgattatctatacgcttgcttccaaagatgtgacatcattttggatctgtaacattttatggatggctctgaacagatgacatcattgcagcatgaaactgttttccagaaaacaagtagtaaaactcccttacttctcttaccacaggtattttacatggagctggactttctcagcttcccaaacagcgccatcagccaagtgatctacatgctgaccaggctccaaacagccatgtcaaatatgtctggtaaaattattgagatacgtgctcaactttacatccatattgtatgttaatagctcctggcttgctctcaagctaatgggccatgcttccagggagcccaggagtagccattgttggcactggcatctcaggcagcacaagagcactgtagagggacaggaagaggctgctgttgccaggtttggggctggctgcacaactcctctgttccgtacctaaccactcaaggaaggtcatacattggcagagaaacccagtcttgctagagggcctgagattccctgtggaaccagcactctaattagaggtgctatttctaatggggagaaaaggagctaataagcaaaaccaagggaaatctttgttcccaggaggaagcaggttctgttaatcagaatcagtctgagaactgacaattacatttcaagctaaaatgggtaactggattggtgagggccctttgcccttgtggaggttgccccattggtaaataatgagcactgataagtgaccatcttttcacagctggcccctggcctcacttttctccttttaaacaggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtacgtttcagaaaacagggcaaccaagactagctggccagggaggttgaggagcaggctggtcactggtacctaggcatttctgagctgcagcctctggagtggctgctggagaccaaggagagctgctacccagaggaggaagtgtagaggccggagggccgctgcgaaagggcactgggaagcccccatccagatatgcacataagccctgtataggagaacccagcaggcggccagcaggactcaaggtctaaagctaagtaaccaagccaattgaacaaggctgatctggcttggccgtcatggggctggggtgctcgatggacaggaaaatggagttacaaaacgagtgggttggttcaggaagggccaggattggggcagcaattccacgcaactgctccacaaaggaggtcccctggtctgaaagcctaaagtcaggtccttggctgcctgaggcctgcaactggctgcagggtgctggaggtctgtgggtgctggaaaggaccaatgcagaagcaaggggcatcatgaaacaagactctccactccctcccctacccccaaacctggagacttcaagggtcaacattttgtgaagtggtctctctctcaaatccactgctttgtattctgtggctgtgttctctttcccacaggatagtttcccaccccctgagtaccacagaatcccccctggggatgatacttaaggctcttggggcagctccatggctggctcctggcctgcataaattaatgtggaacagatgcgcaggcaaggcatactgggtgtcaagagtcaagggggagccccaaccagacagaccccagcttcctgtagcccagcccagggtaaaaacaggtgcacccactggaaaattgctctctgcccctccttcctggatgatggcctgatccatgagatcctaattatttacctaaataatagacatctttttccacacagcaagatagtggtggatcagtggcaaactggagtctgctggccctaacctggggactgagtggccccagcaaaggacagcaaacctacctccaataggttctgcctgatccctcctttcattattctcttcctgggatgggggcgtgtatctccttcacgccactgtttgggtaaaattatctgagaagatggaaagcagccaaccacaacaactcttaagatttctctagtttcttggatcatgatcatagtcaggctttaagctagggtttggcaccaggactacattgctgcttcaagttgatgactttctgagaataaacagaggtcagatgtccaggctgactttattagatctgccagaatcttctgatcagttgagtaaagcagcggtgatttggctataggatttggcaagggataatatcattacgattaaatctttagtccttaatgagaaacctccaaggccctgtgaccatcatgattccttagctgcttgggaaatatttcagatcttaaactattaagactgcagatttcttttgctgttgaactgtcttcaactgtgatccttctcttgtatttttgtttgaggcaggtactgtggagaatcatcatagctggaaggaaacagacctcagtttccctaggggttgagatagtatctggagtcaccactcctaaaagttgctgagattattgggattgtggaatcagagaagcaacactgaagctctagataccattttcagcactgattttccactgctgtccagggctgaaagagggttgggattaaggaatgcctaaaacagaagtgggaagacatgactgagagcaggagcactgtgcctgcacagccaaggcccggcactggctggaaggtagatgggccagtgtgccttcagcctccacattctgctttctctattccactttctctctcctgaagtcattaataggaataactgctgccttaatcctatgtctataaccccaacctctcctactcacccccaagaaaactcaagctgcagagcgtctttgagactaaaccctcccaagtgctgtaatctagagtattttcaacatgagtgggcaggggagggtggccagcagcactgccttgtcagtgagctttcttgagctgtctggctcttagtgcatcccaacataatccacagacatgaggaagcctgtctgccgtgaacacttccagtgaagactaaaagtagtattttaagatctataaatgacttttctggtttttagcttttgcctagttcctttgaattttggaaggaattaatttgtagatgacatcatgcagtacatttaaatatggcaggattgagatttattttttaagtcagcatttgcttttcttggttaaatgcaaccagtttaggggtaataactgcttaatatgcctggcacattattgaaatcccttatgagtggctcaaaatgagtcagaaggtcaatttagtccttggctgggttcctttcacaacaggggttttcctgtgctgctgttcaggaggagcaattaaaactttttgtgtattcaaagctttccagctgaattctggccccatcaaatgatatcagagctctggcttttgcctggtggtgcagagctttcgtctgttagtgaatctttggggaccgtttttccccaagcttaaaaacacaagattcaaactctaagggattccttacttattcttctagcaagcctctttactatctctctgccatcgcacggactttctccagcttttaagacactttgatagcattgttactggaccacacgcagaactagaaacaagtctttctttaccacttcttccagagtagtcttgccaatgttcagtaggcaaaaaccacggaaagtttggtggctacctgagattcacaaatcagtggcttacaattgcaaacttcccactccacttgatctacacactagatagctaaaggacttcagggtaggaagaatttatagcttcagctgcctttgatgagcgctttctcagaaaatctcactgaagaacctagtgtatctcagttctatttgtgttccactgaagatgagccagacttttatgaacaataaatgtactttacatcctctttttttccataaaaatttccccttccgctgcccagcttctctattttctctggctttaaatcctaggatttagaaaagcagaaaatgttacagttcaaaaggttttttaatgctccgtccaaagccactggtttgaaagaggtgttctccactttaagacgttctatctgaagaggtttggggagctaggcaaacagagcttttatttcagtgctgagtttaatgttgaatagatgatttatgtggaggaaagatttttctccttttttcttgggctggctgctaaagaacaatgacagatgttttaatggtgagtagaatgttatcaaatcgtcaacttcaaacatgggaattttatgcaacaccaaatgcttattctaaggaggctgtcctaagtctcatgcacaactttcagttatactgctaaaactgcattgttatcgttgccatatctcagaggaaaaaaggaaacattctggattaatggctttaatagatgacctaaaaggcataatgtacaaatatatcgaggcaaaagaactaattttgttctggaactctcgtaagggtctggcaactaatctttattatttttggatcctaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatta

SEQ ID NO: 357 - DNA, 864315 bp, Homo sapiens; identical to SEQ ID NO: 356

SEQ ID NO: 358 - DNA, 108494 bp, Homo sapiens
ggcgcggtacaggagcagcactgccggcgggggcgggtgccagggacttggaggtggaggggacgcggcggtactctggcgtgtgagccgagggtggagtgcagagggagcgggagcgggacgggaggtcttctagctttggttctatggtggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactcaattttcaagcattatgaatgtgctaatttatgttgtcaaaattctgtatgagcctggaaaacatcacattctcattctcctttttgggcaatggaagggtttgaaagccagcaggaagggtggctggcttgtgggggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttctttcaacctttctaagattaacccatgttgttagaagagtttgtttttcgtattgtcagtactattccattgcataaagattccacaatttacttactcattctcctgttgatggacacttgggtttttaatatttttggctggtgaagaaagcttccataaacattccagtacatctatcttggtaacgtaagtattaatttctcttaggtgtatacctagaaggtaggcctgtgtttagcctgtgttttcattttatattgccaaatagtcttccaaagtggttatatcaattccagtcttaccaacaacttataagcattccaggtatttcacatttttgctactacttgttatgtttgttattttaatgttagcctttctagtgggtgtgtagtgataacctcattgtaattttaacttgtattttcctaatgactaattatgtttttatattcttattggccatttagctatctttttttttttttgtgaagtctaagtcttttttccttttttaaaaattgagttttctgtcttattgatatataggaattctttttttttttttttttttttttgagacggagtctcgctctgttgcccaggctggagtgcagtggtgcgatctcggctcactgcaagcttcacctcccaggttcacaccattctcctgcctcagcctcccgagtaactggactgcaggcgcccgccaccatgcccggctaattttttgtatttttaatggagacagggtttcaccatgttagccaggatggtctcgattccctgaccttgtgatcctcctgtctcggcctcccaaagtgatgggttacaggcatgagccactgcgcccggccaggaattctttatatattttggaaatgagtcctttgccagatagatgttttgcagtatttactctcagtttgtggcttgtctctttactcataaaggtgtcttgatgaataaaagttaataatcttactgaggtccaatttatcaatcttttcccttgtggttagggtttttctagtcttgtttaagaaatcttagcttacaccaacatcgtgaaaatattcttttatatttcttttaggagctttattgaattccatgattcatctcaaattttttttctgcatatgagtaatagaggttaaggttaatttttttccattgatagtcagttgatctataccatttgttgaactcttctttccctactcaattacagtaagcctttgctgtaaatcaggttgccatatgtgtgtggatttgtttctgaactctttattctattgagtggtctatttgtctattcttgtgtcactccatatggttactgtagcttttataataagacttggttggtatctcagtgtaattagtacaactttgttcttttctccttcaagattgtcataactattttaggtcctttgtatttccatatacattttatttttttatttttattttttgagacagagtcttgctctgtagcccaggctggagtgcagtagtgtgatctcggctcactgcaacctccacctccctgtggagcaattctcctgctgcagcctccgtagtagctgggattacaggtgtgcaccaccacgcctggctaacttttgtatttttagtagagacggggtttcaccatgttggccaggctggtctcgaactcctgagctcaggtgatccacccgccttggcctcccaaagtgctggattacaggcatgagccaccacgcccagcctatcatatacattttaatttcaacttataacttttagaattaatttctaaaaaggaaagctgttagtgttttttgctgagattacattgaatctatcgatcaattttggatgaattaacatattaacattgagctgacatagttttgagtttttcaattcatgtacagagcattgcttttcatatttttaggcctttaatttctctcagcaatgttttgaactttttagagaaattttgcatgtatttcattaaattttacctctttttatggatgtttaagtagcattttaaaaacctctattttctggttaggtgtggtggctcttgcctgtaatcagtcacagcactttgggaggccaaggtgggtggatcacttgaggtcaggagttcgagatcagcctagccaatatggcaaaacctcgtctctactaaaaatacaaaaattagccaggtgtggtggctcacgcctgtaatcccagctacttgggacgctggggcacaagaatcacttgaactgggaaggtggaggttgcagtaagctgagattgtgccactggactccagcctgggcgacagagtgagactctgtctcaaaaagcaaacacaaaaaaacctctatttttaaataatttgttaccagtacaggaaataaaatcaattttagtatgtcgacctatccagtggcccaacttgtctaacagtttttggtaggttcttttggattgtccatgttcaatcatgtcacctgcaaataatgacagttttacatctttctatccaatacttgtatcttttatttcatttcatttcattattgcagtgggctaggaccttttatataatgtggagtagaggtcatgagaatagacatccttttttgtttctaatttcagtgggaaagtattcaatgttttactattaagtatgttgttagctataaataacctttactgagttgagattcttttctattaatgattttccaatgagttttaaaaaatcataaatgaatgctgaatttgatcaaatattacacttaatgagttgatatatgatttttctcttttattttgttaatgtggtaaattacattgttttcaaatctaaaccttgcattcctggaataaacctgattatatattatcttttttacatattgttggattcaatttgttaaattttgattgattttgttgtgtctttgcttataagtgatactagcctatgattttcctttctcgtaatgtgattacctggttttgaatgtcatatatatatattggccttattgatttatttgtgaggtattccctctttttataatctctaacagtttatgtaagatcaatgttagtggtttttttaaaattgtgatagaatatgtataatacaacatttatcatcttaaacatttttttttttttttttttgagatagagtttcactcttgttgcccaggctggagtgcagtggtgcgatcttggctcactgcaacctctacttcctgggttcaaatgattttcctgcctcagcctctcaagcagctggcattacaggtgcccacgacaacacccggctaatttttctgtatttttagtagcgattgggtttcaccatgttggccaggctgatctcaaactcctgacctcacccaccttggcctcccaaagtgctgggcttacaagcatgagccatcgtgcctggcccattttaatcatttttaaatgtacgattctgtggtattacgtatgtttacattgttgtgcaaccatcactactactcatctctagaatattttcgtcttcccaaactgaaattctgtatccattagacaccaactccctattttcccctgttcccagccccttggcaaccaccattctactttatgactgtatgaatttgactattttaagtacttcatataagtggaatcattcagtgtttgttctttcgttattggcatatttcacttagcacaatgtctcaaaaagcttatctatgttgtagcatatgccactatgtcctttgtttttatgtctaaataatctattatatgtacatgccacattttgttcattcatttattcgttgatggatagttgggttgctttcatcttttggctataatgctgatatgaaggtaggtgtacaaatatacctgagactgtgcttttaatttatttgggtatatacccagaagtggaattgctagatcacgtgataattctgtgtttaattttttgaggaatcaccatactgttttccacaatgattgcattgttttacattcctaccagcaatgtgcaaaggttcgaagtgctccgtatcgtcactaacacttgttgttttacgtgttttttttttttaaatatagctatcctaatgggtatgaaatgatatctcaatgtggttttaatttgcatttctcaaatgattagtgatgttgagcctcttctcatgtacttattagctatgtttgtcttctttggagaaatgcctatttgagtcctttgcccaattttgaatcgggttctttgttttttgttgttgttgagttataggagttctttatgtattgtggatatcaatcccttagcagatacatgatttgcagatattttctcacatgctgtcagtggcatcttactctataatagtgtcctttgatgcaccaaagtttttaattttgatgaagtccaacttagctatttctctcattcattgtctggatttttgctgtcatatccaagaaatcattgtcaaatctaatgtcatgaaggttttctcctatgttttcttctaatttttttgttcttacatagtataaggtagtgttgcaacctttctctctttttttaaaatgtggatattcagttttcctaacaccatttgttgacatctgtactttcacattgaatggtcttggttcctttgtcaaaaatcatttgaccatagatgtgagagtttatttctgggctctcaatcctattccattgagtaatatgtctgcctttatgatactatcacactgtttggattattgtagcatcgtagtgagtttcagaatcaggaagtgtgagatcaccaacttctcagttttttaagtgttaggaagaattaaacatgaagtcatctgggtaatgatgtaaagttataaactgctgatttaatttaagacatataggatcatttagacttttatttctggtgttgtcagttttggtgagttgtatctttcaaggaatttccctatttcttgaaaattagggatcagcaaactgtgtcctgggcctgcttttgtaaatacagttttattgaaacatagctattcattttgtttattgtctatggctgctttcgccctaaaacagaaggattaagtagctaggacagagattgagtggcttgcaaaagcctaaagtatttactgtctccctctgtactgaaaaagtttgctgtcctgctctaaatcgttatatgtaaggaataaagttggtttttttgttgtttactttttaattttttgagccaaagtctcactgtggctgggcacggtggctcatgcctgtaatcccggcactttgggaggccgaggcgggtggatcacgatgtcaggagttcgagaccagcctgaccaaactggtgaaaccctgtctctactaaaaatacaaaaattagctgggtgtggtggcgggcgcctgtaatcccagctactcaggaggctgaggcaggagaattgcttgaacccaggaggcggaggttgcagtgtgccgagatcatgccactgcactccagcctgggcaacaaagcaagactccatctcaaaaaaaaaacaaaaacacaaaaaaacaaagtctcactctgttgcacaggctggagtgcagtggcatgatcatagctcactgcagtcttgacctcccaggctcaagctatcttcccacctctgccccctctgagtgccagtgccaccatgcccgaataatttttatactttttgtagagacgaggtctcacgatgtttcccaggccagtctcaaactcctgggctcaaatgatcttccaacctcagcctcccaaagtgttgggattacaggcgtgagccccttatgcccaggctggtgtttattataaagctgcctgatttacaaaaatgtatctataggatctgctgtgatatcttcttttcatgtctgatgctcgtaatttgtatttttttcatcgatattgctagggtcttattaattttattaatattttcaaagaactaatttttctttttgttgattcttttttgaattgtacttgtgctttctttgtcatttatttttgttcttatttttataatttctttcactttttttggatttggtttacttttcttttttctagtttcctgagttggaaacttaagtcattgctttttttcagtctttttctactcaaatatatatatataatgctataatttttttctctaaccatatatttagcactgtcatgtgggatttcatgttgtcttttcattaagttaaaaaaattttataatttccattttgatttctttaattattgggttattatttggcttacttagaagtatattgcttaatttccaaacatttaggaatttattaattatctttctgttactgatttctaatttaattccactgtggtcagcagcacattgtctgtatgattttaatttattaaaatgtataaatatatagtctgtttttgtaagtgtttcatgtgcaattgataaaaagtgtgtattctgcacttgttgctgtagcattctgtaaatatcacttaccagaaattggtcattagagttcttcaaatcttgtaaatccatatggattttcattgtttgcttattctgtcagttactagatgatgaggtatgtctggagatatggagattgtgaatttgtgtatttctcatttttagttttgttagttttcactttatatatcttaaagttatgttattaagtgtatacaaatttagtatcatgaatctcattgtttaatatacttgaaaaaaatcattctgaaaagtgtccctcttttttttctttttggtattgtggtccctctttttccttgttttgggttgggtttgattttgtttttctactctcaaggtggacattttaggttattgatttgagatctctctcttttcttttctttttttttttcttttggacaaggcgttgccctgttgcccaggctagagtgcagtgttgatcattgctcactgcagcttcgaccacatgggctcaggtgattctcttgcctcagcctcccaagtagctaggaccacatacatatgccaccattaaccatctctcctgcttgcccctcccaccccttctacccttcccagcctgtggtccagctgtaattttgtatctgttaataaacatcttcctagtccccattttttctttaccttcctagtatctagtaaccactgttatactctctacttctatgatatcaactttttcagccctatgtatgagaatatgcaatatttgtctttctgtgcttgacttatttcacataacataatgaccttcatttccattcatgttgctgcaaaagacaagattttttttctggcataatagtattccgttgtgtgtacacaccacattttcttttctttctttcttttcttttttttttttgagatggagtcttctctgttgctcaggctggagtgcagtggcgcaatcttggctcactgcaacctctgcctcctgggttcaagcgattcttctgcctcagcctcccaagtagctgggactacaggtgcacgccaccacacctggctaatttttgtatttttagtagagacagggtttcaccatattggccaggctggtctcgaatgcctgacctcgtgatccgcctgccttggcctcccaaagtgctgggattacaggtgtgagccactgcacccagcttataccacattttctttatccatcattcctttgtagatggatagttaggttgattccatatccttgtattgtatatagagctgcaataaacatggaggtacaagatatctctgtcatactaattttatttgtatgtacacccagtagtgggattgctggattatatctagttctattttcagctttttaaggaacttttgtggtgttttttataatggctgtactaatatatgttcccaccaaaagtgtgtaagtgttctcttttctttatatcctcagcagtattttgtttgtttgtttgtttgtttgggtaatagctattctaactgatatgataccttattgtggtttttatttccattttccctgtgattagtgatgttgaacatttttcatatacctgttggccatttatgtgtcgccttttgagaaatgtctactcagagcaattgcctattttaaaattggagtctctttgtgcgtgtgtgtgagagcgtgtttgtgtgtgcatgcgcacatgtgtgctattgagttgtttgagttccttgtgtattatggatattaacctcttataaaatacaataaaatatttgtctagaccaaagtcccaaagcattttctcttatgttttcttctagtagttccatagttccaggaattacatttaagtctttagtccatcttgagttgatttttgtatatggtgagagatcgggatctagtgtcactcttttgcttatggatatccagttttcatggcaccattgattggagagactgtcctttccctaatgtgtgttcttcatgcctttgttaaaaatccattggccataaatatgtgggtttgtttttggttttgttgttctgttctcctggtctgtatgtctgttcttatgcaagtaccatgctgttttgattactatagctttgtagtttattttgaagtcagaaattgtgatgcttgcagatttgttcttttgctcagaattgctttggttattcagagtctagtagccaaatacaaattttatctttgcttgttatgtatctgtaaagaatagcattgataatttaataggaattgcattgaatctgtagatctttttgggtcattttaacaacagtttttccaattcatgaacatgagatgtctttctaatttctttgtgtcttcctcaatttctttcaccagtgtcctgtcatttttttttgtagagatcttttacctccttgattaaatttattctaaggtattttattttttgtagctattcgaaatgggatcactttcttgatttctttttcagctagtttgttatcgttgtatggaaacactactgatttttgtagattttgtatcctgcaactttactgaatttatcagttctaagagtttttttgatagagtctttaggtatttctgcatatgagatcttgtcttctgcaaatagggacagtttgactttttcttttccaattttgatccctgtttcaaaaaatttttttcccttgcttaattactctggctgggacttcagtactatgttgaataagggtggtgaaaatgggcattttgtctttttccagttcttagaggaaaagctttttggcccattcttgcattcctgggataaatcccatttaattatggtgtataatcattttgctgtgctattagatttggtttgctagtattttgttgaggattttgcatctatgttcatcaggcatattgtcttgttttctttttctgttgtttccttgtttggttttgttattagggtaatactggccttgtagaatgagttaggaaggattttctatccttcagttttttggaatagtttgagaagaattggtattctttttcaaaagtttagtggaattcagtagtgaagccattcagtcccaggcttttctttgttgagtgattttattactgattcaatctcattactcggtattggactgttcaggttttctgtttcttcttggttcaattttggtagattatatgtgtccgggaatttatttgtgttctctaggtatactaatttattggtgaatacttgttcataatggtcactaacgatcctttgtatttctgtggtttggtctctttttttcttagtctgtgtaatagtttgctgattttgtttatcttttcaaaaaaccagcttttcattttgttgatcctttgtattgtttggtctctatttcatttattttgttctgatcctcataatatctttccttctactaattttgtgtttgttttgttcttgcttttctaggtccttgacatgcattgttaggttgtttatttgaaatctttcaacttcttgatacaactgtttaatgctaaaaactgtttgtactgtttttgctatattccgtaggatttgctatgttgtatttctattttcatttgtttcaagaaattttaaaatttcttgtttaattttttattgatccattggttgttcaagaacatgctgtttaattttcgtgtatttgtacagtttccaaagtgtacttgttactgatttttagttttattctattgtggttagaaaagaaacttgatatgacttggacttttaaaatttttggagaatttttttgtgtgctaatggcaagaatgtatcccgcagctgttgttctgtaaatatctgttaggtctatttggtctaaagtgcaattgaaatttgatatttttggctgattttctgccagcgatctgttcaatgctatgagtggggtgttcaagtccccaactattattgtaatggagtctatctctctctttagatctaataatatttgctttatctatctgagtgttctagtagtgagtgtgtatatatttatagttgttatagatgcttgccaaattgacttcattattattatatgatgaccttctttgtctccttatatagtttgtgacttaaagtgtattttttctgatataaggataactactcctattcatttttggtggaacttttttcattttttcattttaagtttatgtgtatgtttacagaagtgagtttcttataggcagcatatagttgggtcttgttttatttattttttttttcccccgctccgagacggagtctcactctgtcacccaggctggagtgcagcggtgcaatcttggctcactgcaaactctgcctcccaggttcaagtgattctcccgcctcagcctcctaaattgctgggattacaggcacccaacatcatgcccagctaatttttgtatttttatggagatggggtttcaccacgttggccaggctggtcttaaaactcctgatctcaggtgatctacctgcctcggcctcccaaaatgctgggagtacatgtgtgagccactgtggccagccaggtcttggttttggtaatccattcatccagtttatagcttttaattgaggattatagtttttaatttggggtttttatttgtttacattcaaggttattattgataggtgaggaatttctgttgtcattttgctaattgcctttttttttttaaatatatatccattcttccttccttactttcctattgtttatctttgcagtttggtggtttctgtggtgataagttttacttctctttctcatttgtgaatctgcttcatcagtgagattgacacttcttcatgttttcatgatggtagttatagtctgttcgctttcagttctaggattcccttaatcatttcttctacatctagtctagtggtgataaattacctcattttttgcttctctgggagattttagttttccttcatttctgaagggtagttttactagatatggtaatcttggctcacagtttgttttctttcatcattttgaatatggcatcccattgtctcttggcctatgtttctgctgagaaatctgctgttagttttttttatttttttatttttttattttttatttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacaaagcacatcttgcaccgcccttaatccatttaaccctgagtggacacagcacatgtttcagagagcacagggttgggggtaagatcacagatcaacaggatcccaaggcagaagaatttttcttagtacagaacaaaatgaaaagtctcccatgtctacttctctccacacagacccggcaaccatccgatttctcaatcttttccccacccttcccgcctttctattccacaaaaccgccattgtcatcatgacccatccccaatgagccgctgggcacacctcccagacggggtcgtggccgggcagaggggctcctcacttcccagtaggggcagccgggcagaggtgcccctcacctcccggacggggcggctggccgggcagggggctgacccccccacctccctcccggatggggcggctggccgggcggggggctgaccccccccacctccctcccggacggggcggctggcggggcagaggggctcctcacttcccagtaggggcggctgggcagaggagcccctcacctcctggatggggcggctggccgggcggggggctgacccccccccccacctccctcccggacggggcggctggccgggcagggggctgacccccctcccccctcccggacggggcagctggccgggcggggggctgaccccccccacctccctcccggacggggtggctggccaggtggggggctgacccccccacctccctcccggacggggcggctggccgggtggggggctgacccccccacctccctcctggacggggcaactggccgggcagaggggctcctcacttcccagtaggggcggccgggcagaggagcccctcacctcccagatggggcggctggccgggcggggggctgaccccttaagttagcgcttatgggggctgaccccccccacctccctcccggacggggtggctgccgggcggagacgctcctcacttcccagacggggtggctgccggacggaggggctcctcacttctcagacggggcggctgccgggcggaggggctcctcacttctcagacggggtggttgccaggcagagggtttcctcacttctcagacggggcggccgggcagagacgctcctcacctcccagacagggttgcggccgggcagaggcgctcctcacatcccagacagggcggcggggcagaggtgctccccacatctcagacgatgggcggccgggcagaaacgctcctcacttcctagatgggatggcggcggggaagaggcgctcctcgcttcctagatgggatggcggccgggcagagacgctcctcactttccagactgggcagccaggcagagggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcaccttgggaggccgaggctggtggatcactcgcggttaggagctggagaccagcccggccaacacagcaaaaccctgtctccaccaaaaaaaaaaacgaaaaccagtcaggtgtggcggcgcgcgcctgcaatcgcaggcactcggcaggctgaggcaggagaatcaggcagggattttgcagtgagccgagatggcagcagtacagtccagctttggctcggcatcagagggagaccgtggaaggagaccgtggaaagagggagagggagagggagagggagacggagagggagagggagagggagagggagagggctgttagttttatggagagtccctggtatgttacttcacacttttcctatttttaaaattctctttgtgtttgaattttgacagtttcactataatgttcatcttttctcagtttgactataatgtatcctgagaggacctttttgggttgagtctatttgggaaactttgagcttcctggacctggatgtttatatttcttccgtgacttgagatgttttcagcaattatttatttaaataggttttatatgctttgtctgttctcttcttctggatctccaaaaatacatgcttttttttttttttttttttacttaatagtatcccataggccctgtaggcgttcttctcattctttttaattatctgttttttttgtttttttttttcggctaacctgggtacagcaggacctcaaaataatgttcagcgttgtttagttataatgttgctgagacaaaaatgatttctggttaggacctctgtctttatggagtttgcttgttctccccatgtctgcatgggttttctccggatactctggtttccttctgcttcccaaagatgtgaatgtttggttaactggtatgtctaaattgtcccagtatgagtgagtgagtgtgtgtgtgtgtgtgtgtgtgtgtgtgtaccatgatgtaatggtgtcctgtccagaactggtttccactttttaccctgagtgtctggataggcttcagccacctgtgacactgaactggaataagcaggttggaaaatgaatgatcacgttactataaaataaaaatgcgtaaagtatatgataatcatacaaatgcacaatatattatgcgttcagaaagcactcagtgatctcaccatattcattgtttttttaactgtgtggcattagaggatgctcgttttcactttgcaaacatttatttcatgatttcattcataaccattgtgacttctgtcattcgccaattcataaatttggtaaatatttattaatcttaattttattaatttagtagtgtactaatttgatactaatttaataatttcattaatctttcttaaatgtacatataacctacatctatttcagtatttgatattagaagtggtttgactctttacaatattggtgatgtttttgtgactagacgtaggctgtaggaacttttgtttatatcagttagcctaggtaaaattagttttgttacatgttgtttcatttaaatcacagtttccaagaacccactgatgatgtcaggtgaagatttcctgtatttcaaaagacttatgttcaagttcacaaattcttctgcttgatctagtgtattgccgaagctttcaattgtattttttaattttattcactgacttcttcaatgccaagatttctgtttggttcttttttatggcatatatctgttcgttgaatttctcattcagatcatgaattgtttttctgattttgttgaattaactatctgtattcttttgtatttcactgagtttccttaagaaattactgtgaattcttttcaggtattttataggtttgtcttccttggggtatgttattagagaattactgtattcctttgaggtgtcatgtttccatgccttttcgtgtttcttgtgtccctagcttgatatctgtttatctagaggaacaaccacctcttccaattttatgaagtagttttcgtaggaaaaaactttttcctgtagatttgacttacagtactggttgagtagggtgtttaggcttttttcctcattgggtgcagtagtgtaatttctatgtgatttcttcacccgtcatcaatatcagcattttctgtgagtgcctcagtgggctagattgtgggtgtttgtggaggcagtggtgtggctttgcttggggtgaggaatgctaggcaggctggtccttagtccctgagaaatggctgctatttctcagctgccattttctgattacagtgtccaagggatgtagagatgccagggctattgagccccaaggcagaatgcactccagcagttgcttcattctccaaatgatatagtactgcagcaacttggatcctgaggaattcagtggatcaaatgcgaattctctctttggagcaatccagccttatggacctcaggtagctccctatactggactcagggcttgtgaggactgtggaactgccctgtagcttggattgcaagtatccacagtggtcatggggactgctgaggatgtcttgcttaacttttctcgtcaatagggagtcccttctggctccaggctgatcttggccaggtgctctcctttcccctttatgctgacatgtggagtttctgtacctcagaagatcttcattacttcctgatgagttccattgttctcccatagacactaaactcaaactgctctatttgttgttttggtttttctttgtggaggagatgaacattgggtaccattttgattgaagtttttaatctgttcacttctaatttttattcatatgattggatttacatttatcattttgctattattttctgtgtgcctcatgtcttttttgttcctctgatatttattaatttcttttgtaataaattgatatttttgatgttctattttaattcctttattgattttcaaattgcttttgaattactttctttctttcttttctttttttttttttttgagacagagtctcgctctgttacccaggctggagtgcagtggcgcgatctcaactcactgtaagctccgcctcccgggttcacgccattctcctgcctcagcctcccgagtagctggaactataggtgctcaccaccatgtcgggctatttttgttttttttttttgtatttttagtggagacagggttttacgatgttagccaggatggtctcgatctcctgacctcgtgatccacctgcctcagcctcccaaagtgctgagattacaggtgtgagccactgcgcctggcccgaattattttctttgtgattgcttgggggattataatatgcatctgatttactgcaaactagttgagattattgataactttattccattaaaatagagaacatttctctactatagctccattttcttctgctgcttgtgctgttattgtcacatatattgcatcttgttaaaagttcaactatacaattttatcattattgttttatgcaatttccttttaaaccagaagaacaaaggagaaaaaagcatttatactgtcctttactagtcaccaacataattacctgtatcgttttgttgtgtgaatttgttgtgtgaagtagctgttgctacttcctttcagcctaatgaacttcctttaatattctgctaggaatcaattatcttattctttatttgagtatattttaatttgcttgcattattgaaggataattttgctggatatagaattcttggagaaattaggtgttaatctactaaaagtttccttgtacctgaaaaattatttttgtctttctgctctcaatatctatatattttttgtccctggctttctgcagtttgactatgatatatttggatttgaattcactgattcttttgccaattcaaatctgctgctgagcccttctagtgaattttttattttgttgattgtactttcaactccaaaattttcattttttttgtaatttgtttttattgacattttctaattgatgaatcactgttgtcatatgtttctttaattatttgaatatgaggctgggtgcggtggctcacacctgtctgtaatcccagcactttgggaggctgaggtgggtggatcacttgaggtcaggagttcaagaccagcctgaccatcatggtgaaaccgcatctctactaaaaatacaaaaattagctgggtgtggtggtgggtgcctgtaatctcagctattcgggaggctgaggcaggaaaatcatttgaacccgggaggcagaggttgcagtgagccaagatcatgccattgcactccagcctgggtgacagggtgagactccatctcaaaaaaaaaaattatttgtatatggtttcccttatttctttgaacatatttggaattgatgttttgaagtctttgtgtaccaagtcctgtatttgatctccttcacagatagtttgtttctattgactatttttatttctgtacactttgcatgtgtcatagttgtttgttgtaaattggacattttgtgtaatatattgcagcagctttggattttgatttcttctcccccaggagatggttgttgtttcaggattatttgtttattgacttgcctcgactaattttgtgatgtctgtttcgtgtgccttctgatttctctgctcattaaaacaaattctcttttctatttttaagcctggcattctaggaatttcgctgggttactataacttagtcatcagccagtgattgtttggaggttgtttaaacctttgagctagttaggtatttactctttggcatgggatatatacatttattgggtaatactttcaaagtcaggagattataagtctgttttttttttttttaaattctctatgttcatgaggcctcatggttaactcgaaatgagtagcttgctagttactgccctctctttgtggttgcttaggggattatatctgtgtatctggtggaacaacagatatacagtcttctgagtaagtactatcttgcacatgcatacaactttctagactaccagtaatatatatgtgagaccctggcaagaccctgttgggctatatcattttccagatttctctgttaatttttgggctggtttgctgttttgttgcctgacccaaattgtattgtgaccctatgctagccttactcttattgctgctgagctgtctgttgtttttgacaactttgtcctgttttgtcattgctttttggggagaggatttgccgagctcctcattcagcactcttgaagtcttgtcgcatgcgcgcgcgtgtgtgtgtgttcctgtagtaacaaacatgtgacataaaatttgtcattgagactgggcatggtagctcgtgcctgcaatcccagcactttgagaggctgagatgggaggctagcttgaagcccaggagttgaagacaagactgggcaacatagtgagactcatctgtgccaaaaattaaaaaaattggttgggcgtggtgacgtgcatataatcctagctacttggcatgctgaggtgggagagcccaggagtttgaggtttcagtgagctgattgtgccactgcactccagcctgggtgacagagttagaccttgtttcttaaagagaaatgaccatcttaagcacttttaagtgtatactatattactattaattatatgcacatccttgtgtagcagatcttcagaacttttttgtcttgtaaaactgaaactctctatctattgaaccaatgactccctttttacctttcccctgccccagcccttgacaaccaccagtctactttctaagagtctgacaatgttagataccttatatatgtggaatcatacagtatttatcttttcgtaactggcttattttatttaccataatgtcctcatgtttcatccatgttgtggtatattatgggattggcttatttttttaaggctgaataatatcccattgtatgtgtgtattacattttgcttatccattcatcctaaaatgagtattagagttgcttttactttacagctattgtgattaatgctgctttgaacatgggtgtgtgaatatctccttaagattttcttttaaattattttgggtatatacccagaattggggtttctggatcattgtaattctgtttttgatttgttgaggaacctccatattatgttctgtagcagttgtaccattttatgtttccactaagagtgtataagtattccattttctcaacacttactatgtttttgataatggccattgttatggctgagagatatctcattgtggtttttttatttgtatttccctaatgagtagttatgctgagcttcttttcatatacttattggccatttgtatatcttttttgtggacatggcttcaattcctttgtccattttaaaatagaattattgttattttgttgttgattagtcataggacttgtttatatattctagatattagtaccttatcagatagatggtttgcaaatatttttgtccatttcataggttgtcttttttactctttttcctttgttgtgcagaagttttaaaatttgatgtctcatttttctatttttgcttttgttgcctgttatgttcattttaaaagtatcccttttctctgttattttataataccttacctagaattagatttttgagatatattcaactctgttctgaaattctttgctactaatatcctttgcattatcatagatgttctgattttagggatgcattttacatgatgtattaactaaaagttatacataaataaagtatttttaagttgtagacatatatttcaagaagggaaaagaatgaaaagaaaattccttttttggttatcttaaggaagatccatttgttataacaatcatcatttgtgtttcaccttttactatatatgtatgttgtttatttttccttcctctgtgattttgaaattgaaactatcttgcttatagtcagatcatatggctcaaaattccatgttctaatccagaaagccacctcttgtgttactgtttggttagtagcattctgatgatactaagttcttgagtttgattcaggtgtctttaaacatttgtactctgagaactctgagacaatctgatttatgcccttagactgcaactttggtagccattttgcaaatatatcattgttacacaaggcgtagggtggtagaggtggaattgtaatgtgctcattgtccagttagatagataaatagccagtggaaacattttcagtgctgataatggaagtatagaggcagtattatagtggttaattgccatggctgtggaataatatttcttaattttgagtccaggctctcctagatgactcgttttgggaagattcctgacccttcatgtctcagattcttcattgtaaaatggggataatgctatttacattttgtgattcttaggaggagtaaatgattgtatacgagtaaggtgcttagaatagcgcctggtacatactcagtgcttattgcttttgttacaggcactgatcaatatataatcttgtgctagctgaacaatgcttgaagaaattaatgcattttaaaaatactgtgataatgacaaatatctaaaaattgtaacattccattagcatagagtactaacaatagacttaatagctgacctttaaaaaaaaaccctctggttgaagaaacaaattaggcccacacttttgtaataataataataataataagcacctttataatgatttctctgtgaggaaggtagtattctaagctttatatagattaatataatattcaaaatgtagtctttttatacaaattttacagataatgaaactgaggcacagatacaataaactgtctgctggctgcagagttattggtcttaatcactttgctatactgtctgtatttaggcatattgttactgtgttgctgaaccaactaggtagactaaaatgtgaatgaataagcttaatatttttattaactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgttttcatacagattttactttgtcatagctctactagggaccatgcagattgcttattacttacatctacaatgaaagtgcagcctaattgtgtccgatttttacattaacatttttagatttttgcaaaggacctgtatgtattttttctttacataatttttctaaatctgaagggaatttctcaggttattttttgggaagatgaaaatatatttacaccaaattttataattgtttttgaagttttggtataagaaactgattttttcttttttcagatttatttatttcttctctgacccatcttacatttcttgctagtgtttttttgcagatgtaatattggttttaaagagtttctaccaaaaattttccaatctaggaaagcaaaataggtcaggaccatagcttattgtggagaatgtttccactttcaccttgcagaagagtagtgtgtctgtcattcatttttattaggtttttttttttttttagcacccacttaatatttaacttttagttttaaggaagattggctataatcaagtaaattgataagtattattaaaatgacttcatatgaatctgtaagtttaacgtattctaaatgtaactttaatctttgtgaagttagggttatgtatgaactgttaaaattatttcctattttaagtggatgctttgagtgccatatcaacccagtggactcagatcttttttccatttatgaaatctttgattccaaacacgtattatccaatttaacttaatatagtttctagaagttaatagaccaatgttatattctcatgaaaatgaaaagttactttgtgaacttctaatatttgagagattaatttagaaatctgtggatagttacattacaacaaagttttactttccatttatagttggtaatacttaaatgttaagtggttcttaattattatcttttcttggaatttattttttttcaaagtctggacttggttataccacccatgcagtgttccatattaaaagagaaaaaaaaaatccagacacttaagtacttttttcattgagaaggtagaagtttcaaggccagatgtcccttaagaaacatgttttaacagaggcaaattacaactaattatagaggctgcagaaaaagacttgtaacacatgacttagtgcaacctagaactaatacttgatattggactatgcagatggctactgcaggaatgatcagatttcctgcttgcatggtatttgggacttgaattttgtggtttgtacagcaaaaggttaaatgtcatgaatgtaaaccactctcaaaacaagtattttttacagatgtttaaaattttgggttagaaaggatttttgaaaattgcagttgacatttggacaaattatttagcagtgtacacctctggagagtaatgcttgggtttatgctagtgattggaattaaattttgcgtaaaaacattgtagatgaaacagattttaaaatagtttattttcctgttttaagctttgattagtatagtatgtaattaagcaggtactagtaaaactgaattagtttatattcaaagtatttcaagttattacattgtagaatcaccacgaagaaaagacgtattttctaaataaaattgtggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatggcatgaacccgcgaggtggagtttgcagtgatccgagattgtgccactgcactccagcctgggcgacagagcgagactctgtctccaaaaaaaaaaaaaaaacttcttcaacctaaagagagtaataaatctgtttctaaaccacctattctggtttttgtaccacctggaacataaatgttaaatcttttcatctaataaatgtaactatttgtaaggctgtttatagaagtaatacttatttttcttaaaaaatttgaaaagtgggaggctgaggcaggagaattgcttgaacccaggaggcggaggttgtggtgtgcagaggccgcgccattgcactccagcctgggcaacaagagtgaaactccatctcaaaaaaaaaaaaaatttgaaaatcatcttttgaacctaaaaatctgagattatcttctaataggagaaatacttgtagtttcactccagattaaacttatttttatgtatatattcttaccatctttctcctttttagcttaacttcttttaaaatcatttttgcaagtttcattttatttctttactgtcattaaccttttaccacctttctcctttttagcttaattttctttaaaatcatttttgcaagtttaattttatttctttactgtcataaccttctaattgttgatatggctctttaagattacaaaaatattctgtttgaaaacctaaggtgattttatccttttatctcatgtacctacaggtttagctagattttaaacaagaaagtgaaaatatttgtatatgtagtattttaaattcagagatagttttctgtttcccataagcacggattcctttcttaaacattttaagtcagataccagtaagccactttttgtttgttttgtttctgtttttgatactgcgtcttgctgtgttgcccaggctggtctcgaactcctggcctcaagtgaccctcctgccttggcctcccaaattgctggaattacaatcaagagccactgatttccagtattaataagaaaaaaattttggtcctgacagcccatagatttaggtgacctgatcaaaaagtgatatgttattactcttgactgtggcattttatgtcaactctttttatagtttcatcttgtactttatttttgtttttctacaaagtctgtgtcagtgtaattagacttaaagatctgaggcagctgttttgatttgaatgtctaattctgatgaagggcttcagaattattttttccactgtagagcagggaaataaagctttctttgattggacaccagcacctatctgctctatctagcagaacttttctgggatctagagaatttccatactttcacaggacgaagtttttttttgttttttgttttttttaattttgtttacatttagataggattttttatttactggatggtcatttgatctggccatcaatgtgctctgtttaccatcagggatttgatggatttacttgtagaaattttacatgtgatcattggaattttaagtgtggattattatgaattagtacagttgttttggtagactattaataatcagtctctattaattgattttaaaaatcaattagttagaatttgagattaggaggcctacaagagaggtatcacctctctcttagcttggctgaagtctgtgtttatcgtcactgttattggtgaggtcattgcttgaatgttataataaatggccttctaattggactgactctagaccattactcttctacacacactcacaaatatctcttatttttttgaagctcatgtgacctgactatataatcatttgtggtcctctgatagctatcatccattgattttgtggtccctcccccactgtgactgaaaattttgttacctggttcacagacttttttttttccaattgaagttcatccatcttgggtcatttcagtgtccatatggattcttacataactctctagcaacacaattccttgatttttaactctgtcatccttatttctgttccatttcagccaatccctttatggttatgttgtggagtttgctgttccttgaagcattctctttattgtggatcctgtctctgtatcttaagtatctcactttaacagtattccttcacttcaatctctcatttgatttattggcactttgctatcatttaaagtgcttatttctctgctacattttggggaaatactttcctgcaaccatgtttccctctctagcttcttttcttttctttataaccacatcatttctttttttttttctttctttcttttttttttttttttttgagacggagtctgctctgttgcccaggctggagtgcaggggcgcgatctcggctcactgcaagctctgcctcccgggttcacgccattctcctgcctcagcctctggggtagctggggctacaggcgcccaccacctcaaccagctaattttttgtatttttagtagagacggggtttcaccatgttagccaggatggtctctatctcctgaccttgtgatccgcccacctcagcctccgaaagtgctgagattacaggcttgagccaccgcgcccggcctctttttttcttttttaaaataagtcaatgtttgtgtgtgtgtgtgtgtttttttaattgaaacgaaattcacataacatacaatcaaccattttatttttgtttatttatcttttaaatttttttatttctataggttattggggaacaggtggtgtttggttacatgagtaaattctctagtggtaattcgttagattttggtgctcccatcacacaagcagtatacgctgtaccgaatttgtgtcttttatcccttacctctttcccccaagtccccaaagtccattgtgtcattcttattcctttgcatcctcatagcttagcttccacatatcagtgaggacatatgatatttggttttctattcctgagttacttcacttagaatgatagtctccaatctcctccaggtcactacaaatgccattaattcattcttttttattgctgagtagtattccattttatacacacacacacacacacacacacacacacacacacacacacacaccaccccccgcccccacggtttctttatccgctcgtcgattgacaggcatttaggttggttccacatttttgcaattgtgaattgttttgctataaacatgtgtgtgctttaaacccatgtgtgcaagtatcttttttgtataatgacttcttttccactgcgtagatacccagtagtgggattgctggatcaaacggtagttctgtttagttctttaaggaatctccacaccattttctatagtggttgtactagtttacattcccaccagcagtgtagaagtgttcctggtttactggagccatgccaatatctattattttttgatgttttgattatggctattcttgcaggagtaagttggtatcacattgtagttttgatttgcgtttccctgattattagtgatgtgaacattttttcatatgtttgttggccatttgtgtatcttcttctgagaattgtctgttcatgtccttagcccactttctgatgggattgttttttttttcttgctaatttgcttgtgttcgttgtagattctggatattagtccgttgtcagatgtatagattgtgaagattttctccgactctgtggattgtctgtttactctgctgactgttccttttgccgtgcaaaagctctttagtttaattaagtcccagctatttgtttttattgcatttgcttttggggtcttggtcataaaatcctcgcctaagccaatgtctagagggcttttctggtgttatcttctagaatttttatagtttcaggtcttagatttaagtccttgatccatcttgagttgatttttgtataaggtgagagataaggatccagtttcattctcctacatgtggcttgccaattatcccagcaccatttgttggatagggtgtcctttccccactttatgtgtttgtttgctttgtcaaagatcagttggctgtaagtatttgggcttatttctgggttctctattctgtttcattggtctatgtgcctatttttataccagtaccatgctgttttggtgactatggccttatcatattgcttgaaatcaggtaatgtgatacctccagattttttctttttgcttagtcttgctttggctaggcagactcattttttggtttcctacgaattttaggatttttttctagttctgtgaaggatgatggtggcatttttatgggaattgtattgaatttgtagattgcttttggcagtatggtcattttcacaatattgattctacccatccatgagcatgagatgtgtttccatttgtgtcatctatgatttcttccagcagtgtttgtagttttccttgtagaggtctttcacctccttggttaggtatattcctaagtattttattttatttttgcagctaatgtaaaaggggttgagttcttgatttgattctcagcttggttgctgttggtatatagaagagctactgatttgtgtacattaattttgtatccataaactttgttgaatttttttttttatcagttctaggaggtttttggaggagtcttgatagggttttctaggtaaacaatgatatcatcaacaaacagtgacagtttgacttcctcttggccgatttggatgccctttatttctttctcttatctgattgctctgggtaggacttccagtactgtttaagaggagtggtaagagtgggcctccttgtcttgtcttccctaaaagaatgctttcaacttttccccatttagtattacgttggctgtgggtttgtcatagatggcatttattacattgaggtatgttacttgtatgccaattttcctgagagttttaatcataaaaggatgccatattttttttgaatgctttttctgtgtctaatttttgtttaaattctgtttatgtggtttagcacatttattgactcgtgtgtgttaaaccatccctgcatctctggtatgaaacccacttgatcatgggtggattatctttttgatatattgttggattcagttagctagtattttgttaaggattttagcatctatgttcatcagggatattggcatgtagttttcttttttgttatgtcctttcctggttttggtattagggtgatatcggtttcatagaatgatttagggaggattccctctttctctatcatgtggaatactgtcaataggattggtaccaatccccctttgaatgtctggtagaatttagctgtgaatgcatatggtcctggacttttttttgttggtaattttttttattactatttcagtcttgctgcttgttactggtctgtccagggtatcaaattcttcctgatttaagctaggaaggttttatcttttcagggatttatccatctcctctaggttttctagtttgtgcatgtaaaggtgttcacagtagctttcaatgatcctttgtatttctgtcttgtccgttgtaatatttcccgtttcgtttctaattgagcttatttggattttctctcttcttttttggttaatgttgctaatggtctatctgttttacctacctttttaaagaaccagctttttgtttcatttatcttttgtattgttttttgtttcagtttaatttatttctgcactgatcttggttatttcctttcttctgctggctttgggtttggtttgttctcgttctctagctccttgaggtgtgactttagatcatctggttgtgttctttcagactttttgaggtaggcatttagggctatgaactttctttctttccttttcttttttttatttttgagatgaagtcttgctttgtcacccaggttggagtgcagtggtgcgatcttggctcactgcaacctgctcctgtggggttcaagcagtttttgtgcctcaccctcccaagtagctgggactacaggcacctgccaccatgcatgactaatttttgtatttttagtagagacgtggtttcatcatttttgccaggctggtcttgaactcctgacctcagtgtatccacccaccttggcatcccaaagtgctgggattacaggtgtgagccactgtgctctgctctatgaactttcctcttagcaccacctgagctgtatcccagaggttttgataggtcgtgtcacaattgtcattcagttcgaagaaatttttaatttccatattgatattattgttgacccaatgatcactcagaaacagtttacttaatttgcatgtatttgcatggttttgaaggttccttttggagttgatttccagttttattccactgtggtctgagagagtgcttgatataatttcaattttcttaaatttattgaggcttgttctgtggcctctcatatggactatcttggagaaagtttcatgcactgaggaatagaatgaatattctgcagttgttggatagaatgttctgtaaatatctgttaagtccatttgctccagggtatagtttaaatccattgtttctttgttgactttctgtcgtgataacctgtctagtgctgtcagtggagtattgaagtcccccactgttattgtgttgctgtctatcttgtttcttagatctggtagtaattgttttataaatttgggagctctaggctgggtgaggttgctcatgcctgtaatcccagcactttgggaggccgagacgggcggattaccagtggtcgggagtttgagaccagcctggccaacatggtgaaaccccttctctgctaaaaatacaaaaattagctgggtgtggtagcgagcgcctgtaatcccagccactcagggggctgaggcaggagaatcagttgaacctgggaggcggaggttgctgtgagccaagatcaagccactgcactccaggttgggtgacagagcaaaactctgtctcaaaaaaaaaaaagaaaatttgggagctccagtgttaagtgcatatgtatttaggattctgatattttactgttggacatagccttttatcattatataatgtccctctttgtcttttttaactgctgttgcttcaaagtttattttgtctgatataaggatagatactgccttttgcttttggtgtacatttgcatagaatgtctttccacccctttaccttaagtttatgtgagtccttatgtggtaggtgagtctcttgaaggcagctgatggttggtgaattctatccattctgcaattctttatcttttaagtggtgcttttaggccatttacattcaacattagtattgagatgtgagataccattccatttatagtgctatttgttgcctgtatacctttttttttttcaaattgtatttttgttttataggtcctgtgagatttatgctttaaagaggctctgttttgatatgtttccaggatttgtttcaagagtcagctccccttttagcagttcttgtagtgctggcttggtagtggcaaattatctcagtatttatttgtctgaaaaagactctatctttccttcatttatgaagcttagttttgctggatacaaaattcttggcagataattgctttgtttaaggaggctgaagatagggccccaatcccttctagcttgtagggtttctgctgagaaatcagctgttaattcaataggttttttttttttctttaataggttaccttgtgcttttgcctcacagctcttaagattcttttctttgtcttaactgtagataacctgatgacagtgtgcctaggcgatgatctttttgtgatgaatttcacaggtgttctttgagcttcttgtctttggatgtctaggtttctagccaggctgggcaagttttccttgattattccccctaacatgttttccaacttttagatttctcttcttcctcaggaatgccaattattcttaggtttggtcatttaacataatcccagacttcttggaggctttgttcatattttcttattctttttcctttgtctttgttggattgggttaatttgaacaccttgtctttgagctctgaagttctttcttctgcttgtttgattctgttgctgagactttctggagcattttgcctttccttcttttatttttttttaacttttgtatttttatttttttatttatcttttttaaattatactttgagttttagggtacacgtgcacaacgtgcaggttagttacgtatgtatacacgggccatgttggtgtgctgcacccattaactcgtaatttaacattaggtatatctcctaatgctatcgctcccccctccccccaccacacaacaggccctgctgtgtgatgttccccttcctgtgtctatgtgtgctcattgttcaattcccacctataagtgagaacatgcagtgtttggttttttgtccttgagatagtttgctgagaatgatggtttccagcttcatccatgtccctacaaaggacatgaactcatccttttttatgggagcatagtattcaatcgtgtatatgtgccacattttcttaatccagtctatcattgttggacatgtgggttggttccaagtctttgatattgtgaatagtgcctcaataaacatacgtgtgcatgtgtctttatagcagcatgatttataatactttgggcatataccaagtaatggatggctgggtcaaatggtatttctagttctagatccctgaggaatcgccacactgacttctacagtggttgaactagtttacagtcccaccaacagtgtaaaagtgttcctgtttctccacatcctctccagcacctgttgtttcctgactttttaatgagtgccattctaactggtgtgagatggtatctcactgtggttttgatttgcatttctctgatggccagtgatgatgagcaagttttcatgtgtcttttggctgcattaatgtcttcttttgagaagtgtctgttcatatgctttgcccactttttgatggggttgtttttttcttgtatatttgtttgagttcattgtagattctggatattagccctttgtcagatgagtagattgcaaaatttttttcccattctgtaggttgtctgttcactctgatggtagtttcttttgctgtgcagaagctctttagtttaattagatcccatttgtccattttggcttttgttgccattgcttttggtgttttagacatgaagtccgtgcccatgcctatgtcctgaatggtattgcctaggttttcttctagggtttttatggttttaggtctaacatttaagtctttaatcatcttgaattaatttttgtataaggtgtaaggaagggatccagtttcagctttctacatatggctagccagttttcccagcaccatttattaaatagggaatcgtttccccatttctggtttttgtcaggtctgtcaaaggtcagatgattgtagatatgcggcattatttctgagggctctgttctgttccattggtctgtatctctgttttggtaccagtaccatgctgttttggttactgtagccttgtagtatagtttgaagtcaggtagcatgatgcctccagctttgttcttttggcttaggattgacttggcagtgcaggctcttttttggttccatatgaactttaaagtagttttttccaattctgtgaagaaagtcatcagtagcttgatgggaatggcattgaatctataaattaccttgggcaatatggccattttcacgatattggttcttcctacccatgagcatgcaatgttcttccatttgtttgtatcctcttttatttcattgagcagtggtttatagttctccttgaagaggtccttcacatcccttgtaagttggattcctaggtatttcattctctttgaagcaattgtgaatgggagttcactcattatttgtctttctgtttgtctgttactggtgtataagaatgcttgtgatttttgcacattgattttgtatcctgagactttgctgaagtcgcctatcagcttaaggagattttgggatgagatgatggggttttctcgatatacaatcatgtcatccacaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattgaaataattttggaaggaatggtaccaactcctccttgtacctctggtagaattcggccgtgaatccatctggtcctggactttttttggttggtaagctattaattattgcctcaatttcagagcctgttattggtctattcagagattcaacttcttcctggattagtcttgggagggtgtatgtgtcgaagaatttatccatttcttctagattttctagtttatttgcatagagatgtttgtagtattctctgatggtagtttgtatttctgtgggattggtggtgatatcccctttatcatattttattgcgtctatttgattcttctctcttttcttctttattactcttgctagcggtctatcaattttgttgatcttttcaaaacaccagctgctggattcattgattttttgaagggttttttgtgtctcttatttccttcagttgtgctctgatcttagttatttcttgccttctgctagcttttgaatgtgtttgctcttgcttctctagttctttaattttttaattatttaattatttatttattttttatttttagtatactttaagttttagggtacatgtgcacaacatgcaggtttgttacatatgtatacatgtgccatgtttgtgtgctgcacccattaactcgtcattaagcattaggtatatctcctaatgctatccctccccgctccccgcaccccacaacagtccccattgtgtgatgttccccttcctgtgtccatgtgttctcattgttcaattcccacctatgagtgagaacatgcggtttttttggttttttgtccttgcgatagtttgctgagaatgatggtttcctggttcatccaggcccctacaaaggacatgaactcatcattttttatggctgcatggaatactatgcagccatcattctattatactttctgtttctatgattttgagtattctaagtacctcaagtaagtggaatcatacagtttttgtcattttgtgtctggcttatttcacttagcacagtgtcctcaaggttcatccatgttgtggcatatgacaaggttcctttttttttcctttttttttttttttcttgcttacaactcttttttttttggttttgatacagaatctcacttggccacccaggctggagtgcagcggtacagttccagttcacttcaacctctccctcctgggttcaagtgattctcctgcctcagcctcctgagtagctgggattacaggcgactaccaccacccccggctaatttttatattttttagtagagactgggtttcaccctgttggccaggctgatctcaaactcctggcctcaggtgatcctcctgcctcggcctcccaaagtgctgggattacgggcgtgagccaccacgcccagcccagggtttccttttttctagggctgaataatatttttttgtgtgtatttaccccatttggtttattcattcaccgatggacacttgggttgctttcatcttttggttattgagtataatgctacaatgaacatgggtgtgcaaatctctctttgagaccctgctttcagttcttttgcatatatactgagaagtagaattgctggatcatatagtaattctgtgttcacttttttcaggaatttccatactgttttctacagtggctgtaccattgtattctcaccaccagtgtacaaaggtttcagttttgccacatcttcaccgacacttattttctgttctttggatagtgtctatcttaatgggtttgcaatctttgaccattttaaaattcaattgtttgtctttttgtttgagttttaagagttccttttgtattcaaggtagtagagtaggtccttagcagattatgattttcaaatattttcatccattctgtaggttgtgttgtcacattcttgagaatgtattttgatgcacaacgtatttaatttggataaagtccaatttgcctatttttaacttttattgctagtgctttcggtgttatatctaagagttcattgctttatctaaggtcttgaagatttccccctatgttttcttctaagagttttaaagttttagctcttatatttaggttgttgatccatattgaattaaattttgtatatggaatgattaattttatatatgatatgttgtatatgggttcaacttcattctatggttatttggtggtccaagcactatttgttgaagagtcttttctttgcccactgaatggtcttgtcactcttgttgaaaataaaccctataggcctatgctggccatagggtttatttctggactcagcattttattccattggtttgtgtgtgtgttcttaagcctgaacaacactattttgattattgtgctttgtagtaagttttgaaataaataagcttcctattttgtatttctgttttttttttgtttttttttttgttacagggtctcactctgttccacaggctggcatgcagtggcatgatctcagctcgctatataacctctgctttcgtgcttaagtgattctccagccttaacttcctgagtagctgggactataaacatgagccagcatgtttgtctaacttttgtatttttggtagagacaaggttgtgccatgtcgcctaggctgatctcgaattcctgagcttaaagcaatctgcctgcctcagcctcccaaagtgctgtgattacaggcgtgagccaccatgcctggccctattttatatttctttttcaaaattgttttggctctttgcagttgtatatgaatttgaagattagctttttcagtttggttcaaaaggccattggaattataatagggattgtactgaatctgtcaattgcttggtagtattagcatcttaacgatgttaagtatagtgatccatgaacatgggatgcctttctatttatttaagtaatctttaattgtgtcagcagtgtattataattttcattgtgtctttcaccttcttagttgaatttattcctaggtatattattattttgggtgctattgtatgtagaattgttttcttaatttccattttggatcatttgttgctagtgtacagatacaccaccaattttggtgagttgatcttttatttatttatttttgagatgaggtcttactttgtcacccaagctgcagtgcagtgatgtgatcatggctcactgcagccttgaccacctgggctcaagcaatgctcccacctcatcttccctagtagctgggaccacgggcacatgccacagtgcctggctaattaatttttttttttttttttttttttagagagagggtcttggtatgttgatcaggctgatctcgaacttctgggctcaagtgatcttcccaccttgtcctcccaaggtgctgggattacgggtatgagccaccatgcttagctgtgagttgatcttttttgtttgtttgttttttttgagacaggattttgctctgttgctgagggtggagtgcagtggtgtgatctcagctcactggaacctccatctcccaggcttaagtgatcctcccaccccagcctcccaagtagcagggactacaggtgtgcgccactatgcccggctaattttttttgtgtgtttttgtagacatgggttttcatcatgttgcccaggctcgtcttgaactcctgggctcaagcgatctgcctgcctcagcctccaaaaatgctgggattgcaggcgtgagccatcatgcccagcctgtgggttgatcttttatcctgcacatttgccagattcgtttgttagctgtagtagtttttggtggattctgtgggattttctatatatagagtcatgttatctgaaaatatatagagatagttttacttttctgtctccaatttggatgccttttcttccttgtcaaatttctttgtctaggacttctagtacagtgtttaatagcagtggtgaaaatgggcatccttgtcttgttatttatctttgacggaatgctttcagcctttaactattggatatgatgttaggtgtgtgtttttcatagaagtttccttctattcctcatcctcattcctccatccagtggaggtggcagggggtgaaatggactctgtgagggtcatccttagttttggttgtttaatgctctatctttgtgctggttggccttaaacatgtagatgaatttcacaggaatatttttactgtgttgagtcttacaatccatctacacagtacgcttctctaattatttagattcctttgtatttctttcatcagcattttcttttttcagcatgtaagtcctatatatgttttgttagatttatacctaaatattttatttcctttggggcatttttaatattatcatatgtttaattttttattttgattgttcattgttaagttatagaaatgcaatttatttttctgcattgatcttgtgtcctgtgaccttgcttaactgtttaattttaggagttttttgggtggattcctttagatttcctccataaataataataccacctacatagacaataatatcacccacaaaaagtatttttttttttgtttccagtctgtatgcctttctaccctttttaaacttataagttaatatttatacctcatggattctgcctccatgatgccgttgtaagcactttggcagagctcattagtaacatcaagcttaaaaaatccagtgtattcttttcatttattttttgattctcatttacctttgccatttaatacttgtcatctctttccaaaaacttcactttcttggctcctctgattctttccctacatctttggcaccctgtctctggctcctgttgttacttttctgctacctatcccacatttaaataggagttttgtaggttttcgttattttagtgctcactctccttggataattttattcccaatggatttagttatcattatatattttttactcacaaaatgctattttaggggtcagtcttttttttcctgaactccagcataagagctaaatgggccttcacctatatgtcccatagaatgttccaaactgaaatcatcttaaacctcaaatcctttcctctttatgtattttctgtgtcagtgaacaattccactgtgtgctttcaatccaaaccaggaaccctgaggtcgtccttaactttacccatcccttatatcaattattcatcagtctgttttctactgctttcctatctcttgagtgtatctattagctttcattggtacttcgaatcatttttcacactgtctctagacatgatattcttaaatgtgggtcatttcctcaaaacttcttttctagttcagtgattttctcagatcataaacttatgtgcaactcataagaaagagactgaaattttttgtaatctagttgttttcgaagtgtgatctgaagacctccaggtgttcccaagttttttctttttatatacaaaatcaacattatttttctaatactaagacatgattcatgatttacttttttcaccctcattttctcatgaatgtagtgtggaattttccagaggttatgtatggcactggaacagactgacggcagaagcaaatatgagaatgtagctgtcttctcttaagtcagatttaaaaaaaaatataatgccccctttttttatttttgttttagaaaatatagctatttttcataaaatatgaaaaccctaaaatctatcatttattttaaattatccataatataattataattaacaaataatggatttatttaaaaataagtcataaaatatataaacatatatattagaatttttttcttttgtatttctactatggtaaatatgtgattctcagtaatttttaacacattaagaggtcctgagattaaaatatatcaggattgctggtctcatgcatattaatacatagcaatcaaaattgaattattttaaattggcaagcaacttgactgaatttataattttggaagttgacttttttcacagtggaggggaagggattggaggaaataatttcagagaattagttagattctttttgccatattttagaagaaaagttatggagcccagatggaactaagtcattgtctgtggcattggagaggtggtgataggttgtgaaggaggatatacagaggaagttctgggatgacttatggaattttactttaggatgattggtgtggattttggtgctgttgatttagattcttttcagacttgtctgtctagctcatcatatgctaacattactagtaattagatctcactgaaggataatacagaaagtaggcatagtacattgtgtgtaaaccacatagaaaattaccattttagtacttatttcctttctttgaaggaaaagttgaaaagttctttattcaacacatgcttactgagttttataacactgtactgaatgctatggatatagtagttagtgatacagacaaaaactttctcttcttttggagtttatgtctttttgagagaaggtctcactctgttgcccagcctggagtgcagtggcttgatcttggctcattgcaacttctgcttcctgggttcaagtgattctccagccttagtgtcccaagtagctggtactacaggcggaagccaccaatgcccggctaatttttgtattttttgtagtgatggggttttgccctaatttttgtatttttggtagagacggggtttcgccatgttggccaggctggtctcaaactcctgagctcttagctattttcccaccttggcctcccaaactgctgggattacaggcatgagccaccatacccagcctctttttggagttttaagaagactgtatcaattgatacagtctgccctctgtaccacggatgtgaagcccatggatgcagaaggctgactgtaaggtatttgagcatccacaggggtcctagaaacaatctcctacagatactgaagtatgactatctatcatgagtggtttatgattttaattttaacatgaagtattgtttgtaatcttagaatcattggatactaaacttttgttttaggtttagcttctgcttttttttttttttttttttgagacagggttttgctctgtcacccaggctgcagtgcagtggtgtgatcttggctcaccacaacctccacctcccaggttcaagcaattctcctgcctcagcctcccaagtagctgagattacaggtgtgcgccattatgcccagctaatttttgtattttttttcgtagagacggggtttcagcacattggccaggatggtcttgaactcctgacctcaggtgatccgcccacctcggcctcccaaagtgctgggattataggcgtgagccactctgcaggccaaggtttagcttctttttgaggtgaaataattggggtcatttgagaacattattgaaaaagaagtaaaaaaactacaaaccacacactgatacttgtagatggatgacagtgtaggtaaatttttttcaaattgtattgtgttccctgagagtttgggaacacaagaaatcatggtttcttgaacttcagcttgtgtctagatcctagaagtaatagaggattctttttagttagctatttgggagatatagtgtgttataaatgtttgattctttaaaaatacataaattgggctaggcgtggtggttcacccatgtaattccagcactttgggaggctgaggcaggtggatcacttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagttctaaatgtggttaggtttaagtttaatgtcttcatattttactggtcccatctgatttttgttcctttttttcttttcctgccttctttgggattgagtatattttagcattctattttctcttcattattaattaaccatactttattttttagtaattgctctagggttgacagtatgcatgtttaacttatcaatgtctactttgaaataatattataaaataccactttataagtaacgtaagtattatcccttacctagaatgtttatgacagtatgctcctcttcatgtcctgtcatgatttgtgctaatgttgtcataactcttacttctgtatgttacacactcacaatggtcaataataataactattactgctttgaataatttttaagaaattaaaacaagagtgtttgttgtgtttacccacactggattttaaggagtgaatcttgtttggtgttcgttgttattttgtgcttctgtgtacacaaaggtgcctatgatgtttcaccttagttgttaaatacttccttaagtcgaagctcatgtctcaacagtatactgttcagccctcctgggatatgtttttgcttccttcaacttgtctaaatccacatattcccccgaagttagatcgattctcaacttcagtatcttatttagtaaaaccattatttgcttctgattccctatgcgttttatagggaagataggacatgccatttcctgtaaataagattagtctaacatttataatacaaatgccaatgctacaaaagggaaaactgttcttatttagggttctgtttatgtagcagttcatacagagaattttcatgtgcgtcaaaaccaataagagattagatatgcctttacaaaacacaataaattatcattattcttttcttttattcaaataagacaacctttcaactgttgaagagcatgggccctgaaaaataactttattatatgtttattttttttgaggcagagtttcgcttttgttgcccaggctggagtgcatgggcgtcatctcggctcactgcaacctccgcctcccaggttcaagcgattcttctgcctcagcctcccgagtagctgggattacaggcatgcgccaccacgcctggctaattttgtatttttagtagagatggggtgtctccatgttggtcaggctggtctcgaactttcgacctcagatgatccacccgccttgtggatcccaaagtgctgggattataggtgtaagccaccacgcctggcctatgtgtttaatttttaattccttaatacataagaatacattattctcttataatagtttaaggtattcagatattttcttaaccattactgaaagtatctgtggatatagatgggcactcaagtatagaatagatgttagaggattgcaactacaaaataaagtatttcttaattattttaaaaatgaatatagtaaacattatggccttttttcctttatttacttatttttaaagcaggatgcatttttttaggagccagagtctcttttatagcaatagtgaaatgaattattgtaatctgaacacttaacaatccataaattgactcttccaagatggcccagtaggaacagctccagtctgcagctcccagcgtgattgacacagaagacgggtgatttctgcatttccaactgaggtacctggttcctctcattgggactggttggacagtgggtgcagcccacagagggcaagccgaagcagggcggggcgtcgcctcacccgggaagtgcaaggggtcgggggatttccctttcctagacaagggaagctgtgacagacggtacctggaaaaacaggacactcctgcccaaatactgtacttttccaatagtcttagcaaacggcataccaggagattatatcccatgcctggcttggtgggtcccatgcccacagagccttgctcactgctagtgcagcagtctgagatcgacctgcaaggcagcagcctggcagggggaggggtgtctgccattgctgaggcttgagtaggtaaacaaagcagccagggaagcttgaactgggtggagccaaccacagctcagcaaggcctgctgcctcatagactccacctctggggacagggcatagctgaacaaaaggcagcagaaacttcttcagacttaaacgtctctgtctgacagctctgaagagaggagtggttttcccagcatggtgtttgagctcagagaacagacagactgcctcctcaagtgggtccctgacccctgtgtagcctaactgggagacacctcccagtaggggccaactgacacctcatacaggcaggtgcccctctgggacggagcttccagaggaaggatcaggcagcaatatttactgttgagcaatattttctgttctgcagcccttcgctggtgatacccaggtgaacagggtctggagtgaacctccagcaaactccaacagacttgcagctgagggaccagactgttagaaggaaaaagaaggaaaactaacaaacagaaaggcatagcatcaacatcaacaaaaaggacatccacaccaaaaccccatctgtaggtcaccaacatcaaagaccaaaggtagataaaaccacaaagatggggagaaaccagagcagaaagctgaaaattctaaaaaccagagtgcctcttctcccccaaaggatcgtagctcctcgccagcaacagaacaaagctggatggggaatgactttgaggagctgacagaataaggcttcagaaggtgggtaataacaaaattctctgagctaaaggaggatggtcgaatccattgcaaggaagctaaaaaccttgaaaaaagattagacgaatggctaactagaataaacagtatagagaagaccttaaatgacctgatggagctcaaaaccatggcatgagaactatgtgaaatatgcacaagcttcaatagctgattcgatcaagttgaagaaagggtagcagtgattgaagatcgaattaatgaaataaaatgagaagagaagtttagagaaacaagagtaaaaagaaatgaacaaagccttcatgaaatatgggactatgtgaaaaaaccaaatctgcttttgattagtgtacctgaaagtgatggggagaatggaaccaagttggaaaacactatgcaggttattatacaagagaacttccccaacctagcaaggcaggccaacattcaaattcaggaaatatagagaacaccacaaagatactcttcgagaagagcaactccaagacacataattgtcagattcaccaaggttgaaatgaaggaaaaaatgttaagggcagccagagagaaaggtcgggttacccacaaagtgaagcccatcagactaacagctgatctctcagcagaaactctacaagccagaagagagtgggggccaatattcaacattcttaaagaaaagaattttcaacccagaatttcatatccagccaaactaagcttgataagtgaaggagaaataaaatactttacagacaagcaaatgctgagagattttgtcaccaccaggcctgccctaaaagagctcctgaaggaagcaataaacatggaaaggaacaaccggtaccagccactgcaaaaacatgccaaattgtaaagaccatgaatgctaggaagaaactgtatcaacacaacaaaaaaagagaatttcaggttgatatccctgaatgaacattgatgcgaaaatcctcagtaaaatactggcaaaccaaatccagcagcacatcaaaaagcttatccaccacgatcaagtcggcttcatccctggcatgcaaggctggttcagcatacgtaaatcaataaacataatccatcacataaacagaactaaagacaaaagccacatgatcgtctcaatggatgcagaaaaggccttcgacaaaatttaacagcgcttcatactaaaaactctcaataaactaggtattgatggaacgtatctcaagagctatttatgacaaacccacagccaatatcatactgaatgggcaaaaactggaagcattccctttgaaaaccggcacaacacagggatgccctctctcaccactattgtgcaacatagtgttggaagttctggccagagcaatcaggcaagagaaagaaaggaagttgtattcagttaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtgcaaaaatcacaagcattcctatacactaataacagacagagagccaaatcatgagtgaactcccattcacaattgcttcaaagagaataaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatactgctcaaggtaatttatagattcaatgccatccccatgaagctaccaatgactttcttcacagaattggaaaaaactactttaaagttcatatggaaccaaaaaagagcctgcataggcaatacaatcctaagccaaaagaacaaagctggaggtatcacgctacctgacttccaactatcctacaaggctacagtaaccaaaacagcatggtactggtaccaaaacagatatatagaccaatggaacagaatggaggcctcagaaataacaccacacatctacaaccatctgatctttgacaaacctgagaaaaacaagcaatggggaaaggattccctatttaataaatggtggtgggaaaactggctagccatatgtagaaagctgaaactggatcccttccttacaccttatacaaaaattaattcaagatggattaaagactttaatgttagacctaaaaccacaaaaaccctagaagaaaacctaggcaataccattcaggacataggcatgggcaaggacttcatgtctaaaacaccaaaagtaatggcaacaaaggccaaaatagagaaatgggatctaattaaactaaagagcttctgcacagcaaaagaaactaccatcagagtgaacaggcaacctacagaataggagaaaatttttgcaatctacccatctgacaaaggtctagtatccagaatctgcaaagaacttaaacaaatttacaagaaaaaaacaatcccatcaaaaagtgggcaaaggacagacacttctcaaaagaagacatctatgcagccaacagacacatgacaaaatgctcatcattactggtcatcagagaaattcaaatgaaaaccacagtgagataccatctcacaccagttagaatggcaatcattagaaagtcaggaaacaacagatgctggagaggatgtgtagaaataggaacgcttttacagtgttggtgggagtgtaaattagttcaaccattgtggaagacagtgtggctattcatgaaggatctagaactggaaataccatttgacccagccatcccgttactaggtatatacccaaaagaatataaatcatgctgctataaagacacatgcacaggtatgtttattggggcactattcacaatagtaaagacttggagccaacccaaatgtctgtcaatgatagactggattaagaaaatgtggcacatatacaccatggaatactatgcagccataaaaaaggatgagttcatgtcctttgtagggacatggatgcagctggaaacaatcattctgagcaaaccgtcacaaggatagaaaaccaaacaccgcatgatctcactcataggtgggaactgaacaatgagaacacttggacacagggcggggaacatcacaccctgggtcctatcatgatgtggggggcagggggagggatagcattaggagaaatacctaatgtaaatgatcagttaatgggtgcagcaaaacaacatggcacatgtatacctacgtaacaaaactgcacgttgtgcacatgtaccctagaacttaaagtataacttaagaaatccataaattttggaatgccttggacacaacagcaacaagaatctataaatattatgcttgctaatagtataatgtataatttaacccttttaacctttacttcaattccttaaagtctttaaaatctcagttggcatcaaaagtattactgagaaaattcttttgtgctttaccgcaaatttatctgaaatgcattcttttcttcttatacattgaatactctcggagttcgttgttttggaattatatgtgattataagatatttcctgttttttcctcccatgctcccattgttttcccatgacacttttagatatttatcatgttggctagatttcgccttttacttttgcatatgtttggaatatgctattttatattatgtagctcttacgtgtattatttattttccgaaatatttgtatttttcttctcccttgagcctctttatcttcttcagcccattttcttacagatacttcctttcctttcctttcttttcttaaccctttagtctttcattagaactgttaaggaataacagaagaaataccttgtcttctttccagtacttttgccaagcataaattttgtgcttttttcttccctagctgttttatagattttcttataattcagacatatttgtggtctgaactttttgccttttataatgaaatcactaggttacaaagcatttataagttgtgtagtttattctgtaaatttttaataaagacagatgatttagagtaggggtaatcaaactatgccccatgggctcactgcctgtttttgtaaatacaagttttttggaacacatccactcttacttgtataaatattgtgtttggttgctttcatgctccaatggcagaattgagaagttgcacatattaggccgttttcacactgctatagagaactacctcagactgggtaatttataaagaaaaggtttaattgactcacagttctgcattgctggggaggcctcagaaaacttacaattatggcagaaggcgaagggaaagcagggcacatcttaggtggcagcaggggtggggggaatgccacactttaaaggccattaaatctcatgagaactcactcactatcacgagaacagcatgggggaaaccatccctgtgatccagtcacctcccaccaggtccctcatttgatttgtgggaactacaattctagatgaaatttgggttggtacacagagccaaaccatattattttgataaagcctaaatggcttgcaagcctaaaatatttattgtctggccctttacagaaagtttgcctactcttattttaaagtatatgatcatttaaaagtgacatttaattctattaaaagtaaaagcataaaataatttaaaaattatatatatttttctagattgttataggaatttgcatgttggtaattgctaaaatttgataacataatacctacataatttgagcccttaaataaatggagtcaggctgggtatggtggctcactcctgtaatccctgcacattgggagcctgaggtgggcggattgcctgagcccaggagttagaaacctgctggggcaacatggtcaaaccccatctctacaaaacagtacaaaaattagctggacttggtggcacaagcctttagtcctagctactctgaaggctgaggcaggcagatggattgagccaggaaggttgatactgctgtgagctgtgatcacaccactgccagcctgggtgacagaacaagagcatgtctcaaaagaaaaggagtcattttgtgattgagagacaaaagaacaagttaataatgacgtttgtcaattattagagtatgtagttatctaataagttattagggtgtgtgtatatatatgtgcacatacattttctaataatttgtgtatgtatgcatctgtatacacagatatttacatgtctagatttcacagtaggttgatctgagaatgacagcatgatctactattactgagtaaattatcattaccattcagggttatgattcttggaaattatattcagaatggcctaagagaggttgttatattcagtgtgttgaacttgagaaggaaattggaagagtattggcagaaaactttagagcgcatatagtttacttttaaaaattctaaatacatttgaaaaaaattctcttgctcctttttccatgaatttttaattgttttaattaaatttttgaaaaaagttttaaagtttttaaaaacaattttagacaagatcttgctctgtccactcaggcaggagtgtggtggcacagtcacagatctctgcagcctcaaactgctgggctcaagtgattccccccgccacggcatcccaagtagctagggctatagacatgcaccaccatgcccagctgatttttttaatttttaattttttggtagagactaattctcattgggttccctaggcttgtcttgaaatcctgggcttaagcagtcctcctgccttagcctcccaaagtgctgggattacagacgtcagccaaagcacctggccccatgaaattttttttagttcttcgattatcttaaaatatgtgatctgttatatcctgttagtaggttattaacatcctaaagtactaagaaattttctatccagtcagttaaatattttgaagtgttttggaatggatgcatgaaatttttctgtgaaaactttaattctttctttgtattatagtacatactttgggaattatatcctgagttttctagaacagttccaatttcatacttattgaaattaactacaactgcttgagattaagtatttgactgcttatggctgccatgaaagtaatgcttgttgcaaaataattcaaatggtacagaagtaaataagtagtaaaagttaatttttttctctttgttttttgtttttctgatactccccttcagagacatatattatctataggtttcctctccactgtctacattaccttcttttctcgaattttatttcttagttttctcattctgcatactgtatttattgttcaaactgttacgtcattgagtattatttcgagatcttgtggctgtgcttcagtcttccattattcttttttcttttgtctcctgtatgtattttcaaatagcctgttttcagtctcactaattctttcttctgcttgattaattttgccattgagaggttctgatgcattcttcagtatgtcaattgaatttttcagctccagaatttctgcttgatttccaaaaattattttaatctttgttaaatttatctgataggattctgacttccttctctctgttatcttgaagttcgttgagcttaaaaataagtattttaggttctctgtctgaaaggtctcatatctctgtctcttcaggattggtcattggtgcttcatttggtttgtttggtgaggtcatgttttgctgtatggccttgatgcctgtggatgtttgttggtttttgggcattgaagagttaggtgtttattgtagttttcacagtctgggcttgtttgtatccgtccttcttgggaagactttccaagtgtctaaagggaagtgagtgttgtgatctaagtctttggttgctgcagctgtatcgcactgggggcacctgaagcctagtaatgctgtgactcttatagacttgcagaagtattgcctttgtggtcttcagtaaggtccaagagaatttcctggattaccaggcagagaataccctggattactgagctccatgctgaactgcttcaggcggggaaaaaggtgacacaagcatccatgtggccaccaccactatgactcgttgggtcagacctgaagccagcatatcactgggtcttgtctaaggcctacagtgaccactgtgtggctactgttgttgttcatttaaggcacaggctcttttggcagcaagtggaaaatccagccatgcttgtgtctttcccttcagagtggcaagttctcctgtagcccagggtgggtctagaaatgtcatctaggagccagagcctagagtctgggaatcttagaaatctgcttggtgttctgttctactgcagctgagctggcacccaagccacaagacaaagttcttcccactgtttcctctccttttcagaagcaggagactctcattgtggccatcatcaccccaggtctgcagtgaatactgcatggctaccagtgatgttcattcaggggccaaaggtttgtcagtcagcttgtggtgattgcttccaggcctgggtctgtccctttagggcagtgggctcccctctggcccaggacagacccagaaatgccatccagaagccagggtctggaactggggaccctagcagccttcttggtgctctgcgattttgtggttgagctggtgtacccaggcagcaagacaaagtcccctttatccttcctctccttccatcaagcaggaggagcctctccttgtggccaccacagctgggaatacgctgggtcacacctgatgccagcacagcactgggtctcacccctagacccacggtgagtactacctgattactgctggtgtttatccactgcccaagggctccttagtcagcgcgttatgaatcctgccaagactggttccttcccttaaaggtagtgggttttcttctggcccaggatggtctagcaatgttatctggcagctagggcctggaatggaggcctcgaactcttcctgatgccctatgctactgtggttgagggcatccaagttgcatgacaaagagctctttagttttccctctcctctcccactcctcaagcttaaggcaggaatgtctcctgggagcttgtttggcaggtggagccaggggtgcggggccgaggtggtataggcactcccctggctgggtggtttaacataataccattcgtgtatttctgtttttattgtttggggttttgaggtcataaccgtaaaatctttgcctagatgagtgttctgaggtgtttctcctgttttcttttagttttaatagttttatagtttcaggtcttaaggttaagtctttaatccattttgagttgatttttgtatgagttgggagatagggttccagtttcattgttgtgcatgtggatattcagtttcactgcaccatttattttagaagatgtcctttccccagtgtgtgttcttggttcctttgtcaaaaatcaggtggctgtaaatacatggatttatttctgggttctcttttctgtttcattggcctgtatgtctgtttttataccaatattgtgctattttggtaatgatagctttgtagtatatttcaaagacagtgtgatgcctgtaggtttgttctttttgctcagggtacccaggcagcaagacaaagtcctctttacccttcctctccttctgtcaagcaggaggagcctctccctgtggccatcacagctgggaatgctctgggtcacacctgatgctagcacagcactgggtctcacccagtgctttggctattcagagtcttttgtagttccagattaattttagggctgtcttttctatttcaatgaagaatgtcactggtatttcaatagggattgcattgaacctgtagattgctttgggcagtatggccatttttaacaatattaattcctctaatctatgaacataggatgtcttttcatttgtatccttttctgtttctttaatgagtgtttcgtagtttttattgtagagttattttttaccttttctgttaaatttattcttagatatttaatttttttgtagctattgtaaatggcattgctttcttgagttctttttctgaccatttttggtgtgtggagatactgctgatttttctatgttgattttgtatcctgcactgaatttatcagatttaagagctttctggcagtctaggtttttctgtatataagatcatgttgtctgcaaagcagagcagtttaacttcctcctttccatttggattttctttccttttttttttttttttttttggtgtggaaacccaggactttcttttctttcttttattttttgtttctttctttcttctttttttttggtcataaagtttcactctgtttccccatgctggagtgcagtggtgcgatcagggcccactgcagcctcaacctccctgactcaagtgatcctccgttctgaggctcccaagtagctgggaccacaggtgtgtgccaccaggcctggctaatttttttattttttgtagagatagagtctccctatattgcccaggctggcctcaaactactgggctcaagtcctcccaccttggcctcccaaagtactgggattacaggtgtgaaccaccatgcccagctgtctttattttgcctgatagctctggctgggaccttctgtactgtgttgagtaagaatggtgaaaatgggcatccttgaaagcctttcagtttttctcatttcagtatgatagtagctgtgggtttgtcatatatggcctttattatgttgaggtgtgttccttctatccctaatatgttgggaggttttatcatgaaggtatgttggattttatcaaatgcatttttagcaccaattagatgatcatatggtttttgtcttgattctgttaatgtgttgtatcacgtttattgatttgtgtatgttgaatcgtcctttcatcccttaagtaaatcctacctgattaggagaatggcgtgaaaccgggaggcagagcttgcagtgagccgagatcgcaccactgcactccagcctgggtgagacagtgagactccgtctcaaaaaaaaaaaaaaattctacctgattatagtatattatgatgcttatttgttgttgggttcagttggtttgtattttgttgagaattttaaatctatgttcatcatggataatggcttgcaggtattttgttgttattgtttgtttgtttttgagacaatcttgttgctcaggctggagtgcagtggtgcaatctcagctcactgcaacatctgcctcccaggttcacacaattctcctgcctcaatctcctgagtagctgggactacaggtgtgtgccaccacacctggctaatttttgtattttttggtagaaacagggtttcaccatgttggtcaggctggtctcgaactcctgacctcaaatgatcagcctgcctctgcttcccaaagtgctgggattataggtgtgagccaccactcctggcctgcagttttttaattgttgttgtgtccttgtctgtttttggtgttagagtaatcctggccttgtagaacgagttagtaagcttcccttctcatcatttttttggaatagtttaagaattggttcttccttgtaagcttgataaatttagcagtaaagccatttcatcctgggcttttctttttagggagagtttttactactcattgaatcttgttacacattattgatgtgctatactattcttgcgatgttataaaggaatacctgagactaggtaatttataatgaaaagagatttaatttgctcacagttctgcaggctgtatagtcatgtagccggcatctgcctagcttctggggaggtctcagggagcttttactcatagcagaaggtgaagcaggaacaggcatgtcacatggtgagagcaggagcaagagagagtgctggggaggtaccacacacttttaaaaactcagatcttgcaagaactcactattgtaaggataattccaagggtacagttccaaaccattaatgggcagtttttccccatgatccagtcacctctcaccaggcctcacctccaacactgggggttacattgaggggccaaattcccaagctatatcaattggtctgttcaggttttctgtttctttctggttcagtcttaataggttgtatgtgttcaggaatttcatttcctttaggtttttaagtttgttagtatacggttgtttattatagtctctagtgaccctttgtcattttgtagtatcagttgtaatgtcgccattttgtttgtgattttgttcatttgggtctttgctccttttaacatggttagtctagctaaaagtttgttgattttatcttttcaaaaagctaactttttgtttcattgatcatgtatattgtttagtctctagttatttctgctctgatctttattgtttccttgtgctagctttgtgttggtttttcctcttctggtttcttgagagtcatcattaggtggtttttttgaaatctttctacttttttgttgtaggcatttattgctataaactttcctcttagtatcgcttttcttgtatctcatgagttttcgtatgttgtatttctatttttgtttaatgaaattttttaatgttttaaattactttattaatggagtcattgatcattcaggagcatgttgtttgatttgtctctatttgtacagtttccaatgttcctcttgttactgatttccagttttattcttgtggtctgagaacatatttgacatgattttgatttttaaaaatttgctgagacttactttgtggcctaatatatgatttacactggagaatgttttatgtgctgatgagtcgaatgtgtattttacagctgttggatgaaatgttctgtaaatatctgttaagtctgtttggcttatagtgcagtttacatctgatttttttggttgattttccatgtggatgatatgtcccatgctgagagtggggtattcaaatgccccactattattgtattggagctatctctccctttagatctaataatatctgctttgtatatctgagcattctggtattaggtgcatatatatttagaattgttatatcttcttgctgaattgatccttttataattaatgactttgtctttttttttttttttacagtttttcatttaaagtctgttttatctcatctaggtgtagctacttctgtttgcttttgttttttgtttatatgcaatatctttttccattcctgtacttctagtctatgtgtatttacagttaaagtgagttatttataggcagcatacagtttggtctttttctttttaaaaattcattaagccagtctatatcttttatcaggggaatttaatctatttacattcaaggttattatttataggtgaggacttatttctgtcattttattgttttctggttgttttatatatcctttgttcctttttcattgtttatttttgtggtttcgtgtttttctgtatttgtaatgtttggttcctttctctttctcttttgtgtatctgctctaccagtgagttttatactttcatgtgttttcatgatggtggatattattctttcacttctagatgtaggactcccctaagcttttcttttagggtggtttagtggtaatgaattccctcagtttttccttctcttagaaagatgttactgttctttcatttttttttttaaaaggagtttcacgctggttgcccaggttggagtgcaatggcgcgatctcagctcactgcaacctccgcctcccaggttcaagtgattctcttgcctcagcctcccgagtaactgggattacaggaacgtgccaccacacctggctttttgtacttttagtagagacaggttttctccctgttggtcaggctggtctcgaactcccgacttcatgtgatctgcctgcctcggcctcccaaagtgctgagattacaagcttgggtccccgtgcctggcctgctctttcatttttgaatagcactttgctggaaatagttttcttggtgggcagtttttttcttttaatattttgaatatattatctcattctctcctggtcttaaggtttctgcttagaattgtgattttagtctagtggggatttctttatatgtgtgttgacacttttctctcgctatttttagaattctctctgtgtcgttgattttgatagcttgagtataatgtaccttggaggactttttctggtagaatccgtttggggttcttgagcttcctgtattgaaatttgtatggctcttgcaggagttggaagtttttagctattatttcattaattaggttttctatgcctttacccatctcatttccttctggattttctaaaattttctgaattttctaaaatctagttagatatttaaaaaagaaaaaagttatcttaaaagacttgtcttcaagtttagaaattctttctgttgcttgatctattgttgaagtgctcagttgtattttttattttattcattgagtttttcagttatgggattttgtttggttgtttttttaatgacatctatctcttttgaatttctgattcatgaatttttttttataaccttgtattatttatgtgttttctcctgtttctcactgaggctcttcgttatcatttcaaattctttttcctttttctttggatctgttactagagaattagtgtgttgctttggaggtgtcatgtttccttgcttttttatgtttcttgtgtctttatgttgatatttgtgcatctagtgtaccgttcacttcttctagttttgcggattgtcttttgttgggaaagactttttttcttatagatgcatctattatgttgcttttgtagggtgctttgtctttgattcttggtgggtgaagtagtatagtctgcatgatttctttggctggaatcaggattagtcttgtctgtgatttccccagtggcttaggctgtggttcttaggtaaaggctttggtgtggctttttcttgggaggaggaagacaggcagactagttctcaggcaccactggtggcagtgatgggctgcgcatgacagtccttggtgccctgtgtggcatatgcaggtgattgtggtgatgggtctagatgggccaaactttggttgtccaggcagcttttctgggtgccagaggtagaagtggtatggtgagtctggtgggtcctcagagtcttgggtagtgtgatggcattggtggtagcaatagcggtggcaggccaaccattgggtctccagtggcaggccagcagtggtgttgggctgggtgtgccggtccccagtcccctaggtggtatgcataggtgagtgctggtgatagtggcaaactgagcaagttggtatataggcccctgggagatgcatgctggtgccagcagtggccatggtgggtgtctgtctaggcccgcagatagtgcacatggtaaaggtggctgtctgggcagattcatcctcaggctgctggaaggtgtgtatgggttctggcagtggcaggccggtaggatcaatctccaggctcccagatatcaggtgccagatgtggtgagtcagtctccagggctctggagaatgggcgtaggcaatgttggtgggcacggctggtctgtccccacaggttggatgggttgatccccaggccccagatggtgtgttttgatggcagtagcggtgggttgggtgtgcctgtcctttgattcctggatggtgtgtgcaagtggtggtggcaggtggggtggtcttgttgtcaggcccccatcatggtgtgtctgattatcaatgacagcaggttggggcagatcaattcccaggcctccagatgacacctgtggctgtggtggcagtttgggtgggctagtcctgtccttactcccacctccccaaaattgaatgtggttgtggtggatgtggacagagcaggttgatacctaggccctggttggcatgctatccatgttgatattttactctagtttataaatgttaactgctgtatagtatagtgtttaatgaatattaaataatgatcctactatgaattttttttatttctccttgtgtatagattttagagttctaaagtggattgttgagttgaagtttatgtacattgattttccccttaatataaaattgtttttttaggttacactgtaagagaatttctgtttgtctatagtgaaatcaatacttgatagtttcatacttgaattttgccagttgagtggttttgaaatgttagctcatcatcatttttacttacatttttatcataaaaagtggttttccgggaggctgaggcaggagaatcgcttgaacccgggaggtggaggttgtggtgagccgagatggcgcccctgtgctccatcctgggcaacaagagcgaaactccatctcaaaaaaaaaaaaaagtagttttcattttaaaaaaattgcctgttcaagtttttttagttttcttaataatgtatcatattataattaataatgtgtaaatatatacttgtgtattatattgtatattatctatatcatataaattatatataacattaatgtttcttttattttgtctttttcttactgcaggggtcattattcagaatacttaattttgttgcatgttaggtgtattgcaaatatattctgtcactctttggattttcctttaactttctttagtgtgtcttttgtgtagaatagcttatttttgtcttaatgaagttgggtttttctggtttttgtatttttcttgcttttgtattttttgcttttttgtttcatgtgaaattttcaactgacctgtggtcataataaaatttcctatggtttcttgtagtaattttaaacctttattttttaatttatatcttttaatcagtggggtttgttttcctgtatagtgtaaggtatggcactttatatgtctaactggttcttcctgtaccatttgaattgtttctcttcccctctgatttataatgctacctgtgtcatattccatgtatccatatatatcacgatctgtttctgggctctcctctgttccattggcttgtttaaattattatggttctaaaataaatcataatgtggggtggaggtaatttccccacttactttatattttgtgtttgtttgcatagatattattcaagtatctctgagaatcctaaacacaattgttgtaagattgtttaaggctgttctagaagattaattttattgtgacttaattttgttgatttccttagctgtcttagcattagatttcttcgtgtgctttagaatggtggtttgtaaggttatttttaacagaaaggtcattatctctctatttcaccatcttcttcttgtcttactcaagcccttcctctgctcattgttagtgttatagttacttcctctggtctatggtctagaatccagttttaccttgacagttcaaggctcttgcattgctgtattgggtgatagcaaagcattgcttatttcgtttttcatgaggtttgtttacttctgacaccctttatacataacttcatgttaaattctaggcagtggttggcagtaagttttttctgcctccttcaaaattggggattcactctgttactggttttaagcgttgagcttggtaacagtctcccatccttacatgacaattttcagttctctttattcttcatctgcctctgccaggttttacatcttttgcatggccacctgtctttctcaatctgactaaatgctttgagtctggttaaaatttttctcttttttatgttattgctagtatttcttgtcctcccccatcctcaatgtttttatctagtcagcctttatcagaagtataaatccttttttctttttattggaaatctaaaagcttcaaagattactttttttattatactttaagttttagggtacacgtgcacaacgtgcaggtttgttacatatgtatacatgtgccatgttggtgtgctgcacccattaactcgtcatttaacattaggtatatctccaaatgctatccctcccccctcccccaaccccacaacaggcccccaccccacaacaggcccccaccccacaacaggccccggtgtgtgatgttccgcgtcgtatgtccatgtgttctcattgttcaattcccacctatgagtgagaacatgcagtgtttggttttttgtccttgcgatagtttgctgagtatgatggtttccaacttcatccatgtccctacaaaggacattaactcatcattttttatggctgcatagtattccatcgtgtatatgtgccacattttcttaatccagtctataattgttggacatttgggttggttccaagtctttgctgttgtgaatagtgcctcaataaacatacatgggcatgtgtctttatagcagcatgatttataatcctttgagtatatacccagtaatgggatggctgggtcaaatggtatttctagttctagatccctgaggaatcgccacactgacttctacagtggttgaactagtttatagtcccaccaacagtgtaaaagtgttcctgtttctccacatcctctccagcacctgttgtttcctgactttttaatgagtgccattctaactggtatgagatggtatctcattgtggttttgatttgcatttctctgatggccagtgatgatgagtatgttttcatgtgtcttttggctgcataaatgtcttcttttgataagtgtctgttcatatcctttgcccactttttgatggagttgtttgttattttcttgtaaatttgtctgagttcattgtagattctggatattagccctttgtccgatgagtaaattgcaaaaattttctcccattctgtaggatgcctgttcactctgatggtggtttcttttgctgtgcagaagctctttagtttaattacatcccatttgtccattttggcttttgttgccattgcttttggtgttttagacgtgaagtccttgcccatgcctgtgtcctgaatggtattgcctaggttttcttctagggtttttatggttttaggtctaacatttaagtctttaatcatcttgaattaatttttgtataaggtgtaaggaagggatccagtttcagctttctacatatggctagccagttttctcagcaccatttattaaatagggaatcgtttccccatttcttgtttttgtcaggtttgtcaaagatcagatgattgtagatatgtggcattatttctgagggctctgttctgttccattgatctacatctctgttttggtaccagtaccatgctgttttgcttactgtagccttgtagtatactttgaagtcaggtagcctgatgcctccagctttgttctttttgcttaggattgacttggcaatgcgggctcttttttggttccatatgaactttaaagtagttttttccaattctgtgaagaaagtcatcagtagcttgatgggaatggcattgaatctataaattaccttgggcagtatggccattttcatgatattgattcttcctacccatgagcatggaatgttcttccatttgtttgtatcctcttttatttcactgagcagtggtttgtagttctccttgaagagctccttcacatcccttgtaagttggattcctaggtattttattcctttgaagcaattgtgaatgggagttcactcatgatttggctctctgtttgttattggtgtataggaatgcttgtgatttttgcacattgattttgtatcctgagactttgctgaagttgcctatcagcttaaggagattttgggtgagacgatggggttttctagatatacaatcatgtcatctgcaaacagggacaatttgacttccccttttcctaattgaataccctttatttccttctcctgcctgattgccctggccagaacttccaacactatgttgaataggagtggtgagagagggcatccctgtcttgtgccagttttcaaagggaatgcttccagtttttgcccattcaatatgatgttggctgtgggtttgtcatagatagctcttattattttgagatatgtcccatcgatacataatttattgagagtttttagcatgaagcgttgttgaattttgtcaaaggccttttctgcatctattgagataatcatatggtttttgtcgttggttctgtttacgtgatggattacgtttattgatttgcgtatgttgaaccagccttgcatcccagggatgaagccaacttcatcttggtggataagctttttgatgtgctgctggattcggtttgccagtattttattgaggatttttgcatagatgttcatcagggatattggtctaaaattgtctttttgtattgtgtctctgccagactttggtatcaggatgatgctggcctcataaaatgagttagggagggttccctctttttctattgattggaatagtttcagaaggaatggtaccaactcctccttgtacctctggtagaattcggccgtgaatccatctggtcctggactttttttggttggtaagctattaattattgcctcaatttcagagcctgttattggtctattcagagattcaacttcttcctgggttagtcttgggagggtgtgtcgaggaatttatccatttcttctagattttctagtttatttgcgcagaggtgtttgtagtattctctgatgatagtttgtatttctgtgggattggtggtgatatcccctttatcatattttattgcgtctatttgattcttctctcttttcttctttattactcttgctagcagtctatcaattttgttgatcttttcaaaacaccagctcctggattctttaattttttgaagggttttttgtgtctctgtttccttcagttctgctctgattttagttatttcttgccttctgctagcttttgaatgtgtttgctcttgcttctctagttcttttaattgtgatgttagggtgtcaattttagatctttcctgctttctcttgtgggcatttagcgctataattttccctctacacactgctttgaatgtgtcccagagattctggtatgttgtgtctttgttctcattggtttcaaagaacatctttatttctgccttcattttgttatgtagccagtagtcattcaggagcaggttgttcagtttccatgtagttgagtggctttgagtgagtttctgaatcctgagttctagtttgactgcactgtggtctgagagacagtttgttataattactgttcttttacatttgctgaggagtgctttacttccgactatgtgatcaattttggaataagtgcggcgtggtgctgagaagaatgtatattctgttgatttggggtggagagttctgtagatgtctattaggtctgcttggtgcagagttgagttcaattcctggatatccttgttaatttctgtctcgttgatctgtgtgatgttgacagtggggtgttaacatctcccattattattgtatgggagtctaagtctctttgtaggtctctaaggacttgctttatgaatctgggtgctcctttattgggtgcatatatatttaggatagttagctcttgtcgttgaattgatccctttaccattatgtaatggccttctttgtctcttttgatctttgttggtttaaggtctgttttatcagagactaggattgcaacccctgcctttttttgttttccatttgcttggtagatcttcctccatccctttattttgagcctatgtgtgtctctgcacatgagatgggtttcctgaatacagcacacttaatggttcttgactctttatccgatttgccagtctgtgtcttttaagtggagcatttagcccatttacatttaaggttaatattgttatgtgtgaatttgatcctgtcagtatgatgttagctgattattttgttagttgatggattttcttcctagcatcgatggtgtttacagtctggcatgtttttgcagtgtgtagtactggtttttcctttccatgtttagtgcttccttcaggagctcttttagggcaggcctggtggtgacaaaatctctcagcatttgcttgtctgtaaaggattttattctccttcacttgtcaagcttaatttggctggatatgaaattctgggttgaaaattattttctttaagaacgttgaatattggccccactttcttctggcttgttgatttctgccgagagatcagctgttagtctgatgggcttcactttgtgggtaacccgacctttctttctggctgcccttaacattttttccttcatttcaactttggtgaatgtgacaattatgtgtcttggagcaacaattatgttgctcttctcgaggagtatctttgttgcgttttctgtatttcctgaatttgaatgttggcctgccttgctagattggggaagttctcctgtataatatcctgcagagtgttttccaacttgtttccattctccctgtcactttcagatacaccagtgagacatagatttggttttttcacatagtcccatatttcttggaggctttgttcatttctttttattcttttttctctaaacttctcttctggcttcatttcattcatttgatctcccatcactgataccctttcttccaattgattgaatcggctactgaggcttgtgcattcatgatgtagttcttgtgccttggttttcagctccatcagatcctttaaggacttctttgcattgattattctagttagtcattcgtctaattttttttcaaggtttgtaacttctgtgccattggttcgaacttcctcctttagctcagagtagtttgatcgtctgaagccttcttctctcaaatcgtcaaagtcattgtccgtccagctttgttccattgctggtgaggagctgcgttcctttggaggaggagaggtgctctgatttttagagtttccagtttttctgttgtgttttatccccatctttgtggttttatctacctttggtctttgatgatggtgatgtacagatggggttttggtgtggatgttctttctgtttgttagttttccttctaacagtcaggaccctcagctgcaggtctgttggtttgctggaggtccactccagaccctgtttgcctgggtatcagcagcggaggctgcagaacagtggatattggtgaacagcaaatgttgctgcctgattgttcctctggaagctttgtctcagaggagtaccgggctgtgtgaggtgtcagtctgcccctgctggggggtgcctcccagttaggctactcgggggtcagggatccacttgaggaggcagtctgtcggttctcagatctgcagctgtgtgctgggagaaccactactctcttcaaagctgtcagacagggacatttaagtctgcagaggattctgctacctttgtttggctatgccctgcccgcagaggtggagtctacagaggcaggcaggcctccttgagctgtggtgggctccacccagtttgagcttccaggccgctttgtttacctactcatgcctcagcaatggcgggcgccccctcccccagcctcgctgcccccttgcagtttgatctcagactgctgtgctagcaatcagcgaggctctgtgggcgtaggacccacccagccatgtgcgggatttaatctcctggtgtgccgtttgctaagaccgttggaaaagcacagtattagggtgggagtgacctgattttccaggtgccgtctgtcacccctttctttgactaggaaagggaattccctgaccccttgcacttccagggtgaggcagtgcctcaccctgcttcggcccacgcttggtacgctgcacccactgtcctgcatctactttctgacactccccagtgagatgaacccggtacctcagttggaaatgcagaaatcacctgtcttctgcatcgctcatgttgggagctgtagactggcgttgttcctattcagccatcttggctccacccactgtttttttgtttttttttttttttatagactgggtctgtttatgtagcccagcctggctgccaattctttggttcaagcagttctccaccctcagcctcctgagtagctgggattataggaatatgctacaaagccctgtttcaagtataacttgtattttaaatgagtcctaagtctttatataactgatctctttcagtctcttctagtacacattcagctttcctgtgcacatatataattgtatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcctttttcattcctgcaggtacagtcttttcaaatctcttgttctttgtgatgttttcctgactactcaatctcactctgatttttcttttctcaggataaggaaaggttaggttggataggttaggaaaggataggttgttaatttagtattatatttttcagttccctttttctcatagggaggcagtagggcaaagtggttagtattgggcatttaatagctgtgtgattttgaagcatttaatctctttatgccttcgtttcttcatctataaaatgaggatattcttgcattcatagagtcgattaggaggattgagatatgaacataatgtctttagcagtatgtgacatattgaaagtgttacaatgttttttctgtttgtctctttttcatccatccctgccttccttccttctgtttgtaaaccaaaaagcatttgagacaagtctcaatttagaagtttattttgccaaggttaaggacaagcctcaggacgtcctgatgacgtgtgcccaaggtggtcaggctacaccttggttttgtgcattttatggagacataagacatcaatcaatatatatcaaatgtacattggtttggtctggaaaagcaggacaacgttaggaggaaggggcttccaagtaataggtggaatcaaagatttgcagttggttgaaagaatttatctaaagacctggaatccatagaagggagtgtctgagttcagataagggattgtggagaacaaagttcttattatgcagatgaagtttccaggtagcaggcttcagaaagaatagattgtaaatgtttcttaatcacacttaaaaaggtgccagactcttagttaattctctcctgtatcagagaaaagaccaccaggaaagggaaagggattctctacagaatatagattttccccacaagagacagctttatagggccatttcaaaatatgtataagggttatactttgatttctttcagggcctgtgatctgtcatgtgatgcaatactagagtcagggtagaatttggtgtcttattgctacaaaaagtcttaagatttctgttttaatgttaatactggtcagttgtgcctgaatttcaaggagaggcgggtataatgaggcatgtctgacctcccactcccatcatagcctgaagtagtttttcaggttaagtttggaatgcctatggcttgagcggaggggtccattcagatagttttgggggctaaggattttatttttagtttatgcctactctccacttttcttaagagaagctctacttttcttatccttgaaatacttgctgcctagtaactgctatttctttgtgacatgtataatcataaacttttttttttttttttttcacacagagtctctctctgtcacccaggcaggagtgcagtggtgcgatcttggctcactgcaacctctacttccctggttcaagtgattcccctgcctcagcctcctgagtagctgggattacaggtgcaaagcaccacgcccagctaatttttttgaagttttagaagggacagggttacaccatgttggccacactggtctcgaactcctaacctcaggcaatccacctgcttcccaaagtgctgggattataggtgtgagccaccatgcctggcctgattaactcttaaattactaactttttagtgtttacataggttttgttatttgagtaaataggtaaaatacttagataaaggtatcaattttactactttttttaaatttttttttcctgaaggtgcctaacacatacttttctttgctcagacatcttttgctgagggaagttatatacaagaaaacaaagtgcagttaaattaatctgttcaataacccagttccccccagtgaatttggtaaaaattagatggtagaatgtggtttagaccagagtagttctgtatttactttttttttcttcctccctgaatttctgcctatttcaccttctaaatcttagagtggatctcacagtttcaattctgtggtttaaaaaaagtgggagagggaggtggcaatcggatacacacccacatacccaccaatatgaaggaaaggaatgtcataggtagcaataaagaacaaatttttcataacatgttttgcaatttctctgatatatgttctggcatagtttaatagtttgattattctgtggctggggcagtatcatgggtcgggggctatgtgggtgaaaagaaggcagaggagagatggctaatggttgagtcatctgggaaaatgactctggtccttttactgagtagcatgggtctcagagattagaagagcagagattagaaaagcacatagaagtgttcacagtgaatatggtgatctcttttattgttaaaatgtggcccaatgaatgttcagcttttggtcattaaggttagttatatcttcctttgagatgatcaaatgaaaagaatacaagggagggtcatttctttttcctttttccagcctgtcataaccccttttttccacccttgatagaagatggaaacagcctcccttgtggactaaagttgatgtgtgaagagattggtgctatatattcctctttatttaagcatgcttgatatatatattttttatgactaaagttaaggttttaaatattgctgttaaggtagagttgagtcagatttctatttttaccatgaaagttagtgaatgtgttttccctggctctctcttgtgctctccaagtgtacctctgagtaaatgactttatttagctttctgtctttgaagtgtgcagtattactctcagagattctttattgcatctggctgttgtcattgtacttgctactggagaggatagaggtgaatgttcctaaaagccttgtagcagttcatttctaagcccctttggtgaccagagctgacaggtgagtcttagttcttttctgcttgcgaagtttggtgccacagggttgaagagcataaagtacatcacctcttagtttcactgtccactttctccttcttcagctctttcctgcatcttaacctcttgctctgtagttttagacaaggacttcaatgatgtagtcacttgttttcagttttattctaaatgttattcacactattgtgaatctgggagttgatggttttctagttttagttgacaaaccctgtgagggacagggagaaaagtgagtaacatgaactcatgatctgtcagtatgaaagtaatggatctgtttacgtgcagtgtttgccacacatttttcctctgttaggaacttttgtaaggaaatgacattcttgcttgtttcatgaggagcaaatggcagtattttcagaaatagctatgtggtccccaagagaaaacattctttggccatgaaatatacttaccagacattttggaaaattgcaacctaaataagatatgactgtaatgcttttggtgttaaagattatcttaaaatattttagctggtatttttgagaacagagtttcttttattagtaattaagggctttcaatgaacgaaaactgtgtaatggtccacagtgatgcctactggttaaaagcagatgatgaattcaaaactaatggaagtaatttcagtcttaatagtaaatattataattattcttattttgctttatttttatttatttaatttgattggggcatgatttgaatggaaactcacttttatttgatacaactaaaatgtaattgaaatgaaagcaagttcaaatcattgaaaggattaatttctaattatagtatatacattgtcaaagtttcctaaccataattaagaaagaagtgtttacatgtttggtaatgtttggtttatagtatatattcctatgagtaccatgattaatgctcattttttaagcacaccaaaatttcaagtttttaaaataaattttgtttaggcaaataaagttatttagtttgtttttcttttgaataataaatacatgtagtttgcagggaagctttactcactttttttttttcagtgctatcattatttaattgctatgtattatatacattttgtatactttggtatattttatattggtaaaatcaatggcaccacaaattaaatatgtcaagcacttatttttaaaattacactgaatgactcctaaagatgtctatacaaataatattataaattttatgatgtagagagataattaaatcaatcaaatacagtatctttaattaagacaacaggaaaaccccaaagaggatttggttactggaaagaacagcacttgaaaaagaacagcctcattaagaaatgtgaaagttatgaagagttaaatacaaaagtggacaaacatatctcacttagagttctttacactgcatactctgggagtctatgctattcaaagcacctcaaatttggaaatttttttttttaaattttttttatttatttattattattatactttaagttttagggtacatgtgcacaatgtgcagtttagttacatatgtatacatgtgccatgctggtgcgctgcacccactaacttgtcatctagcattaggtatatttcccagtgctatacctcccccctccccccacctcacaacagtccccagagtgcgatgttccccttcctgtgtccatgtgttctcattgttcaattcccacctatgagtgagaatatgcggtgtttggttttctggtcttgtgatagtttactgagaatgatgatttccaatttcatccatgtccctacaaaggacatgaactcatcgttttttatggctgcatagtattccatggtgtatatgtgccacattttcttaatccagtctatcattgttggacatttgggttgagagaatactacaaacacctctacacaaataaactagaaaatctagaagaaatggataaattcctcgacacagacactctcccaagactaaaccaggaagaagtcgaatctctgaatagacctttactcacttttttttaacaaaaatttgaaaactcatcgttttcatttaatcccattttgctgctaataatttttaaaaaatagagtaaaaataacttgttctttcttttgctttaaaatgtttgtcatctcacatatgccagatttattggactgcagtagttttagtgcattttggctggaatgtttattatgacatcaccataatctatatacagtatgtgatttcagatggtttcagtgttaaatattttcataattatgctagttttggcagttcacttggaactttttcacatctttttaatgaacatgttttacttctgggcttctgagacaaccatatgtttcaaaaattaataatgtgcttttaatgttaatgttgtgcagaagtgtatgactatggacatttttaaggatttaagttgaactaaaagtaattacagtgaggctttattcacagtagtagtcttttagtatttaagactgtaacatcccccaaataacagaagatgtctttatgaatattgaatagtgaagttattttgtggaatgaaacctgtgatgtttgtttttcattaacttaaaatgaacataagttcatgagaaaattttcagtgttgtttatggttgcaagtctttttgcttgtatgaagtttcaaacaaatttttttctaacgtatcactaccatctgaagccatgctgttttgtaaaacaccttttattgtatatttctcttagtgtgatagtgaataaaagttttcttaaagaggtcttattgtcgttcttatttgcctctagtaccctgttagtttggtaaactagtgatgattattcttttatatgctcttgaaattttcccttcaaatatataaagtagaaaaactaaatttaataccattcttgtaagtattataaaatagtgttattattgattaatgaattcatggtgcgcaatgcactctcagctaccctttgtgttggtatctttgatctctcactccacatgtgcatctttacttcaagcaaaaatgtattcttttatccttaaaaaaggaacaagaagttagttgccagctgatcttccctcatgttactactctacctattttctcttcgtaatgcctatcttcgtgaaagagcaatttattttaattgactccatggtaacttctcattcactctgagctactcatttactgctcccacttctctccctctgtgggaactgctaaatcacctttctaataggttagtggcagcctcctcctaattaccaaatcctgaaacaggtcaactagaatgaggactaagaatatctctatagttgttaacattaccccatttttattgaaaggtctgtgcctttaacttcttccatcttagacactgtatactctggccttatttgactaatcatcattctttgtacgtgctacatacgttgatactgttttgcttttgcttatggttcctcccaccacccctcatttagccccagtctaaacctaaaacatttctacatttgattttgaatggcctgatctttctagttcttccaaacagaatgactctttttatactccttattacttaaaaacaaacaaacaaacaaaaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcagaacaaattgggtcctgggattacaggtgtaaaccactgtaccaagcccaaggtacttttatcttgagactctggtatcttttaggccagactttggattctgctgctttcagccttttcaagaggaaagagtctggagaagacctatctgcttcttaatatccccaggctggaagtgatacatattcctctgatcaaatttcattgaggagaactatttgcagggatattacttatgacttagaagttaaatctcagtagcaattccacattcctgaagtgggagcacaaattattgatggatagctagcttctctgccatacaggtgttctttcttattaatgtatcaatccattcttaaatggattatgcttcaaagtattattttgttaataaccttcaagatagctgatgtttatattttattacagaaaacgtgatcattagagagcctttatttcattttaatttgactgaatttcaaattattgtttagtggagacaggctgtttatttccctaaatgtgtatcactatttgaataatatgctagagcagctcattgagggctatttttgccctcaaagagttaactgtttaggataggagccttttaaactatcaatcacagtacaaagccaaaggaagatgagctctaatgaaccacaagtaatatcttttgggcactaaaaggagggagttgtcatgtccaggtgtgtgtggcttctgaacacacacatgaaacagaggcaagacagatcaaaaatgaaagtatgggagataatataagagacaaatagtagccaaaaataaatctgtatctttcatataaaaatgaggcaaaaataagaaaactaaagacaaaaaacattaatggagataggtaataaagatactaaattataataaaatatatagttctccagaagatacacattgactttgtatggacctaacaatgtgactttgaaatgtcataaatcaagcagggaaaaaaaatctccagattagttcactggatatcaaaattttgttttagtagatacatgtaaactctgcactaggcacataagacagtatacatttcttttgatgcacacattgagtatctacagatattaacaaagacttggttgaaaaggaagtcttgagaaatttcaaagcatcactatcatgtatctttctctctgaccacaatgtgattaaattagattataattattgatgtggttgtatttacttctgccatttcatttgttgtttttctttgttcactctgttttttgttcctgtttcccatctcatgcctactatttactttttaagagccctgaagtagctgctccatacattctctccaggttttatggcttcagtcactgggaaagacagggtggagtgtttactttatcttatccagaactgaaaccggttaacattgtggtgtacaaccttttagagagtcttttcttcctttacacacacacactcacacatatgcacacaaaaacaatttgttataacctaaatttttcatttaatgttatgccaaaaacatgtttccaggccattcacattttttacgttgttatttcaatcagtggcatacaatcctgttgtataactcttctacagtttatttaaccagtcctttttttggtttgatatttaggttatttgttatttttagttttgtaaaatgctttagcaaacatatgtaggtaagtctttgcatacacctctgcttatatctttaggaaaactcctttccaatttatagagtcaaaatttgtgagcacttttaaggtttttggcataaaatggctaaattactctgtggaaagtttgtaacaatactttattccaatcacatttttagtgtaatgctgttttttattattaaaaaaatctcttaaaacttttataggtggaaaatgctatcatacattttattgctaattgggatttccatctttaccattttctttttatacttttttgttaggaaagctaatttttatattttgttagctgaccagtattcagtattttttagtcgcttcttttggagtttctatataaaaagtactgtcatctttgtgaaatgacttttttccctcctttgcaatacttatacactaatttctcttttttccctttatttcattgtctagaacttctgtgaccatcttaaataatatagtatcaccaactcacatcggtttttttagctcctacagtaattgcccaaaattattatctagttattaaatctgatgtttttaattcatattttattgggcctgtctataacattgacagtaaagattttttattcttgcccttttaacaaagtttttattttgaaacaatttcagcatttcataaaagacaagaacattctaaagaacttattttccctttaaccatttgagcataaatttcctatctgatgctacataatgctcaaataaattttacaccaaaaacttgactacgatgtttttatgtactgtaaccaagtcatcaaccgtggcatttctgattatgagcagcttggcttcccagtgaccacatcaagatgaatcaattgcagatggtgtctctttgtaaccaaaattttttgatacatgccatttaagactatcagagaaataaataagatacagtcttttttctctaggacttcacagtttatcagagaagataagcatacatatacataaaaaatgactaatagtaacataagcccaagaaaagtggtagagacatttctctttaatgttgaggtgtaggatggaggacattggagaagacaatataaggcagaggaaaattatactgcacctgaacaagaagtgcgaatggacaaaaagtattgtaaaaaggaggaagaacacgagtaaagttagtgaaaattagtgttttcatctgggcctgtggatatagatgtatgtttggaagaaggggttatatgaggtatggggagaggtagataataagaatttctggagaaaggttgactagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaaatggaaagaaaaaaaaatatatatattttgagacacggtttcactcctgtcacccaggctggagtgtgatggtgcaactttggctcactgcaacctccgcctctggtgctcaagcgattctcttgccttagcctcctgagtagctgggactaaaggcacatgccacgacacccagttaatttttgtatttttgtagagacggggttttaccatgttgcccaggctgatctcgaacccctgagctcaaatgatctgtctgcttcggcctcccaaagtgctgggattataggtgtaagccaccatgcccagccagaaaatatttttaaaaagatgaacaatccatcagtagtgttctatcagttaaaatacatattgtgttttgtttctattactttgcattatacttctatgctatttttgatactgttttaaagataataaaaactcatgaatgcttacgtggtttttaagagtactgtattggccaggcatggtggctcatgcctgtaatcccagtactttgggaggccaaggagggcggatcacgaggtcaggagttcgagaccagcctgaccaacatggtgaaaccccatctctactaaaaaaaatacaaaaattagcctgacgtggtggcacgtgcctgtaatcctagctactcaggaggttgaggcaggagaatcacttgaacccgggaggcggaggttgtcgtgagttgagatcatgccattgcactctagcctggacgatagagagagactagtctcaaaaaaaaaaaaagttccctgttcatgacaggtttttgagaaatagggaaaccaatattagtcatgctcacttgacttcttggaaacatttttatttatttattttttagatggagtcttgctctgtcgcccaggctggagtgcagtggcacgatcccggctcactgcaagctccgcctcctgggttcacaccatcctcctgcttcagcctcctgagtagctgggactacaggtgcctgccaccacgcccggctaatttttttgtatttttagtagagacagggtttcaccgtgtcagccaggatggtctccatcttttgaccttgtgatctgcctgccttggcctcccaaagtgctgggattacaggcgtgagccaccgtgcttggccccatttttgtttttaaaatctgcattgagtagtaataatatggggttatgtacattctaaggttaaaatgttgatacttacaatttcttttggaggtctcatttattaagaattattttagcatctactcatggaagagtaattgttactttaaatctattaatattttgaatgttaattttatagcatgtgataattggcactctaaaagctgctaatagtttctatataggagaaaacctcgaatctaagttgtattacatttctttcctatttgcatcattgggaatgaatgaaggagttgggttttgcacacgttatggttgaatagatttaagtaagtcttctctcagcaggctttagtgtaggtgttaacaatgtcagatgctgacagaagttgattatgttttgtccagtaaaattctgggttaaagaatacaaccatatggttatttcatgaaatagctaaaattttaattaccttttaaatagttttctttaatagtggaaatgcattaccttttagttagctttttacagtggaaaagattaatttttttttctcctggcttttaaaatgctttttataaagtgttatttatatttttaactaaattactcaataatgtatccatgtacacacttacatgagaaacataagtgagattatggagtattcctcagtagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcctcccgagtagctgggactacaggcacctgccaccatgcccggctaattttttgtatttttagtagagatggggtttcaccatgttagccaggatggtctccatcttttgaccttgtgatccacccgcctccgccttccaaagtgctgggattacagatgtgagccactgcgcctggccaaatttttgtgtttttttgtagagacaaggttttgccacattgcccaggttggtcttgaactcctgagctctagcgatttgcctgccttggcccctcaaagtgctgagattacaggaatgagccaccatacctggcctatacttgttttttaatacttttaattttcattctttcttacttgccacatgcttgtttcaaatgtgatgtataatacagtcatgcattgcttaacaacagggacatattctgagaaatgcatcttaggcgattttgttgttatgcaaacatcatagagtgtacttacacaaacctagatggtatagccagtacacaacctcaggtatatggtattggctattattgctcctaggctgcaaacctgtacagcatgttactgtgctgagtattgtagatagttgtaacacagtggtatttgtgtatctaaaaacagaaaaggtatagtaaaaatatagtattataatcttatgggacagccatcatagatatatagtctgttgttgacttaggtattgttatgcagtgcatgactatattttatagtgccatgggttgtagcaataaaagttaaatgatatttagtttgaattgtttatgtttttgaaaggtgaaaggcatcatgtttcatttacaaagcttggtgaaggcaaggcaatatatctgattgatttatgttttaggcttgtgtgttccaaagcacatttggaatttcttccttcttttcctcccctctccccaccgtcccccctcccctctccctttcatcctcccttccctttccttgcttctcccctgcccctttccctcttccccctttcctttttgagaaagggtctcattctgttgcccaggctggagtgcagtggtgctaccttggctcactgcagcctcgacttcctgggctcaggtgatcctcccatcttagcctcccaagtagctgggaccacaggcgtgcactaccatgcctggctaatttttgtatttttttgtagagatggggttttgccctgttgcccaggctggtctcaaactccttggcttaagtgatccacccaccttggcctcccaaagtgttgggattacaggtgtgagccaccatgatagccctggaatttcttgattatcctgaagcctgtttttatctctttttaatgtttagtcatatattcctttattcatcataaatcccagttaaagggttaaagcaaagtgaaattgagtctcaagagtatttaacttgcctgattaaggcatacaactaggaagtagcagaactggaatagagttttattattatgtgttttctaagctttagtcttcacatttaacaaaaggagagtagtcctgattttacaactttgttgtgagcataaaagtgtaggtaaggcccaagcatcatttcttatatatcgttaatgcctcctttgcatcttctgtggaaagaaatatttgattaaaaggctggaagaagcagctatggaaaatagaaaacaaatagaactggacaatgtaggattgtattaatgagttgacatttgtggtgaagaaattttattttaattaattaattaatttttttgagacagagtctcgctctgtcacccaggctgaagtgcagtgacgcaatcttggctcactgcaacttctgcctcccgggttcaagcgattctcctgcctcagcctcccaagtagctgggactctaggcgcctgccagcatgcctggctaatttttatatttttggtagagacggggtttcaccatgttggccagtctggtcttgaattcctgacctcaagtgatctgcctgcctcagcttcctagaatgctgggattacaggcatgagccactgtgcccacccagaaatttaattttagtatagaagcaatttagtatggtatagaaatttaatttagtatagaagcaatgccagttttactttgggaaattatttatagtgaattagaattctggatcaggagttggaagatcttagtttgaatcttctctccactgctaatttacagtgcaaacttgggtgagtcatttataaaatgactgcttctaacttgccagtgtactcttcagaagcaaatataccatatgaaagctcatgatgatggtggtgataaagacagtgaaaatagtatcttctgtttatttagtaccagggctagtgttacatattttatattaattatcttgtttaaccctttaactctctgaggaagaaactattattttcccttttattagtttttttttaaataattttttttaattgaagcataacatgcaagaaagaaagagcattaagcaaaaacacatagctggccgggtgtggtggctcacgcctgtaatcccagcattttgggaggctgaggcgggcggatcccctgaggtcaggagtttgagaccagcctggccaacatggtgaaacaccatctctactaaaaatacaaaaaaaattagctgggcacggtggcaggtgcctgtaatcctagctacttgggaggctgaggcaggagaatcacttgaacccaggaggcggaggctgcagtgagtcgaaattgtgccactgcactctagccttggcgatagagtgagactccacctcaaaaaaaaaaaaaaaaaaaacccaaaacaaacaaacaaacaaaaaacccatatagctaaacgacataccacaaaatgaacatactcttgtaaccaccaccaagctcaagaaattgaacaatatcagcacccagaagtgcttgttgtacatatactcacttactactgccccttctttccccaaagcaaccactttactgacatctgacaccatagtagggtttggactctttttaaatttttgtatgaatggaaccatatgtattttgggcctagattattttgctcaatattatgtaaatgaaatttattcaggttttcgtctgtaacaatagttcagttctgcgtgtatatatctattccctctccctgcacaatcaggtgagcaagggttggggttctgcctgcactggtctttcctggatatatgtgggatggcgagtttgcaggtctggtctgtgttgtgaataaaacatttttttgctcagtgtaccattgatatagatttaattatgtccagttttggctataatgaataatgctatagcgaacattttcatacatgtcctttggtggacatatacatacatttctgttgggtatatgcctaggagtgaaattactgggtcatagtgtaggcctatgttaagcttcagagatactgacaaatagttttttcataatagtaatgccatttttttactaacaagtaatgcacgaggctgtattaaaatattgcagttaaaataagaattgtaatatctttgtgagggtaaaaaggcaagccacagatggaagtgtatattcttgatacttaaaatttgcaacatacttatatccacaatatataacttctataaatcaataagaaaagaatagacaactcagtagaaaaatggacaagagacttgaacaaacacgtaaaaaagagtataccccaaagaccaataaacataagatgttcaattaacaccaaatcagattgcactaaatacttgccataatggattaaaaaataaaataattgggccatctatctattccttctcctttaactcattccttccccttacgtattttttttttataatttccaagacttttatttcagtataaaggtcttcagaatatctaatcttttctactattagaggcagaatcctatcatctcccatgtggttgacattcaagttgttctaaaatattgacattgcccatagtgctggaatgtacatccttttttatgtttccttgttacgtgtttgaattctgtaaattatgatcaggaaaagaataactgcatatgtaaacattcagttatgttttatattgctgaattgttctctaaaatgattaaatcaatttattaccatccatactatctgtgagaattaatatttctttttattcctttccaagttgtattttaggttgagagggtacatgtgcaggtctgttacttgggtaaattgcatgttgcatgcatttggtgtacagattattctgtcactcaagtaatgagcatagtacctaatggttagtcttttgattcttaccttgctcccaccctccaccctcaagtaggccttggtatttattgttgccttctttgtgtccatgtatactcagtgcttagctcccacttataattgagaacatgcagtgtttggttttctgttcctgcataatttgcctaggataatgccctccagctctatccatattgctgcaaaggacatgatttcatccttttttatggctatgtagtattcgatggtggatacgtcttgtattttctttatctacttcactgttgttgggcatctaggttgattccatgtctttgctattgtgtatagtgctgcaatgaacatacacatgtgcgtgtctttatggtagaaagatttatattcataagcgtgttgcctatgcttttgaggtcttagtcataaattctttgcctagaccaatgtcaggtcttacatttaagtctttaatctatctcgagttgatttttttaaatagtgagagataagggtctaggtttgttcttctgcatatagatatccagttttcccagcaccatttattgaagagactgttcttttcctcagtgtgttttcttggcccctatatagaaaatcagttggctgtaaatgcatggattcatttctgggtttttgattttattccattgggctatgtgtctttttttatgccagtaccgtactgttttggttattattgcttttagtatattttaaagtcagggagtatgatgcctctagctgtgttctttttgcttggggttgctttgagtatttagggtctttgtggttccataaaaattttaggattgttttttcttatgtctgtgaaaaaatgtcattggtattttgatagggattgcattgatttcgtagattgctttggatagtatggaaatgattttggaagaattccctccacttcaattttttggaacagtttgtgaatattggtattagttctttaaatgtttggtagaatatgacagtgaatccaaaggtcttaggcttttctttgattgctttttccaggttttggaagttttctctatttctttgaataagcttcctaacctctttttaaaaatagtattcttatatgttgtattttgggtttgttgttttcaatcaatactatgcttttaatatttctatatattggtgtatatagttgtagagccctaatttcagtgatgaataatattttactgattaaattgtagcacatttctaaagtaagtaccagaaactagaattcattttctaagtttttgaaatatagttgctgttatattttgtgtttaagaaaaaatacctttaaaacagtaatgtcctctttcactgaataataattgtctagggtctagggtatccttgaaatttgaatacttcactttttctttctttcttttttttttttaagagagagtcttaactctgttgttcaggctggagtgcagtggtgtgatcttggctcactgcaagctccacccctgggttcaagccattcttgtgcctcagtcacctgagtagctgtgattttctgcatttgccaccacacccagctaattgttgtatttgtagtagagatggtgtttcaccactttgcccaggctggttttgaactcctggcctcaagcaatccgcctaggcctcccaaagtgctgggattataggcatgaaccaccatgcctggcctgaatagcttacattcttatagcaaagtagataagaacatgcactctgcagtaaggttgccagagtttgaattacagctctgatctttataaactgtataacaatagacagactattaccactgtgcctcagttttcacattttttaacaggaccgtgtaaatattgtcagataagagatgtaaaagacttagtgtagtatctgagtaatagcaaatactcagaaaatgataattgttatcataaagagagggaaggaaacatctacaggatatctttttttttctcatttctggtcctactattgtaatttcttaatttgtgtacatatataatattagtaactaaatcattattcatataatatgtaaatttgaaatatggtagtcatatgtctttttcaactaacagacaactttgaaatttatctgcaaataatactgtttagacacatcttctttaatttctactttttaaaaacttataaaataaaatgttgaattaattagaagttgccaggatatactcagaaatagtgttataacctgaactaaaacacattttattgttttttaaattcccatggctaacttaaaatcactgggcaagtagatttgggcctgatatttacctaggaattgcttatcagttaagaaataagaaatattgatttgctaaaggcttcatttcatacttttatactttaccatcaattgttttatttttattcctttgaaaatatactctagagtgttattggtgatttctttattaattaatgtggtggtgtccactagacctttctgtgataatacaagtgttttatatcttctctctccaatatggtagccactagccacatgtggctgttgagcacttgaaatatagctagtgcaaccaaggaccttaatttttatttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctgctatctatactttttcttctctttactaggtgacttcgtaaagcttgatatactaacctaatagtttattggttcaagaagttttagcttttgatttatgatttttaaaatgtaattaaaatcttagggagttattcaggacatgtctttttattttttatctgcattttcatttaagattaagggatttgttacaagggtatattgtgtgatgcttaggtttgggctcccactgataccatcatccagatagtgaacatagtacccaaaaggaagtttttcagcccttttttcctctccctccttccctccttttagaatccacactgtctgttgttcccatctttatgtccatgtgtacccaagatttagcttccacttctaagtgagaacaggacatgtcttttgatacatgtgaaaattttctgtccaatgtagtgtatgttttcaatgtatgtgattagtatctaagcataaatattgttgtcttatttaacagttttctgaacattgtttgtctgcctatcattgtatcttggaaaaagaattcagtgacttctgatcccattaagtaggttttaatgtggagtaaatgtttattgttgaactacttgcctctgactgtcaaagttctgtagatggaagggctggacttaggtgtctgaacactggtattaactactgttcctgtttgagtatggctgtataaaaattagttttgtttttgttaccttatattttattaaaaatatagtattttctattttacgtagccttactgtacttaatatgtaaaatctacatgtttttttcttggtagtgcttagtcacctgtgttttacttttttccacacggtgtataatgcatattggtttgtttatattctgttactttttccttctatatttgaattagcttctttggcaaagataaacatggaaaagaattaactcagtaatagtgatggctctgtctcagggaaatacgcttattttctatagccttgggttttctagtaaatttggggaatgtgaaggtaaattgaagatacattgaaagcaagtaatggatatatggaagcttactatataaaatactctttttgatcattagtgcaaatgtaatggtctattctaggatgtggttatattagaggaaggtaaaaatagatgaggaaaaacttagtgttggcatataagtaagtttgtgttctcaaaactgattagtcattacatttcactgaaaaagtcccttatcataaataaacttgtataatagttgccaaatatgtgatatcaatgtgttatactcaactgaaatcaattttggaggttttatttctttcttcttttcttttctctctttcttttttctcccctcctctccctctccccacccttcccctcccctctgtttccctcccctctcctccgctttctctccttttttctttctccttttttctttaccttcgaggctccctgtcacccaggctggagtgcagtggcacaatcatacttcactgtaaccttgaactcctggggtcaagcgatccttctgtctcaggctcttaagtagctaggactacaggcgcatgtctccatccctggctcattttaaattgtttttttgtagagacggagtctcactgtgcagcccaggctgatactgaacctcctagcttcaagtaattctcttgtctaggcctcccaaagtgctgggattcctggcatgagccaccatgcctgcctgagttttttgttaatactattgtaatgttaagatttgccattttgggttagacccatcattcttccaagtcctaatcctagggaatatgtattaaacagatatggtcgacctcattaattacttcacagaggtttctcaaaatgttccagatactatatttcttttcttctttttttttgagacggagtcttgctcttgttgaccaggctggagtgcaatggcatgatctcggctcactgcaacctctgcctcccgggttcaagtgattctcctgcctcagcttcccgagtagctgggattacaggcgccggccaccaggcctggctaatttttgtatttttagtagagacagggttttgcccttttggccaggctggtctcaaactcctgacctcatgatccgcctggctcagcctcccaaagtgctgggattacaggcatgagtcactgcgcctggcccctctatttcttttcaaatctttcatgtatgtttattttgaatgtatttatatgttgggttggctttttataattttccattttttttgtgtgagatacatacgttctggtgattatgatgtttatgagatacagatcctatgggtacgtaatttatttaacatttctcctgtttttagaaatttactttgcagtttctcagagcagtgaaattctgtgcatagaactttgaccacatttcctgagtaattccttaggaaagatttgtataattgcaaatatcttttttttttttttaagacctgtgatctgtattgccagattgtttccagaaagatttaaccaggttatactcacatgaacattaaggggagtgcctatgtcatactcttattatccttaaatatgatcatattttaaaaattgccaacttgttgaacaacaaatgatatgtaatttaattgccgtttattagtgaagttagatttttgaaaacacattcactggtcatttgttctttgtattatcagttcaggttctttatccatttttctactgagtattaatcttactcattttaaggagcttttaaaaagatacttatgacagattctttgttattggttttgctgactgcttattaccagtgctattggtgcaatacaagatttaaaagaatgtgacagaggaatttcaaattaaggaaaccttagcagacatgcatactcctttcctgctcacctcccacactcattccccgctttcttacctcttcattgtttattcagtgtatgattattaggtcagtttttaaaagcttgtgctcatatttgaaatatggtatttcacagtccccccatatagttttctcccccttcacatacatttttttatgtgctttgcaccctaaaaatacgatgattaccattactattacttcatctttcatagacactgaaatacattagtcaaaataaaccttctaagagacttgactttatggcataattggttttactccgtgtttagataacagcaggaaaccattacactgaagttgtgtttatattccactgatgtctctttctttaaggagagctttgattgctgtatatcctatttgctagtagttaatcttatttctttgttataatggtttcattttatcagttgaataagttttatgtcatttaaatcttatctacaatttggaaaacttttgttatttaaatcttacttaaaatttgtctgaaaaacttttttcaacatatatttcacttgtttttccatatttgacaaaaatttttattatttacatactttcatagttgtaatactagtcttttccccagttaacatatggttttaggatgtatatgtattctttatggttaataaacctggaaagaatgattagagtttcactaaaatgacataaaatttttattattcttggttttgacagattgttctgttttttgaggataatactgttattctcttaatgttatagagtagctatttggttatataactaactttgtttctggaatagtaatctggaaatctagtgtgattataccttctcactattaattccatttgtatgtacatcatttggtttaatatcgtttctatctaacgtgtattgatcatcatagcaaaatttacttaattcctaagatcttagagtaagtattgttttgatttaagtattaaaatgtttggagcatttcttttatgttatgccatttaaagactttaaaacatttctttatgtaaaaaatactctttttaaacatgcgtttgttggtgttatgtctttttcaaaatgcagattcatactttagtggaaagtttgaaactttctatcacagatcaacaactgcctatgtttattcgtataatgcaacttggaattgctctttactatggagaaataggcaattttaaagaaggcgaaatagaggaccttacttgtcataataaagatatgctaggaaacattacaggtaatgtaaaactttattaaacaaaaactttattttaagactattcttacgttttaccattgggaaactttaaaaaatgtattagcttgagttttacagtattctaatgagatgggctgattgttttttggttgttttacactattttaatttttttgtttgttttgttttgagatggagactagctctgttgcctgggctggagtgctgtggtgcaatcatggctcactgcaacctctgcctctcaggttcaggcagttctcttgcctcagcctcccaagtagctgggattacagacatgcatcaccacgcctgtgtaattttgtattttttttttttagtagagatgggttttcaccatgttggccaggctggtctcaaactcctgaccttgtgatctgcccgcctcagcctcccaaagtgctgggattacaggcatgagccactgtgcccagcctacactactttaattttatctacatgctggataacattctgattttctcctatatgctaaaaataacttctatatttataatagatataagtgttcagaatgtactacttatttatttatgaatgagggttttgctctgtcacccaggctggagtgcagtggcatgatcatgggtcactgcagccgcgacctcccaggctcaggtgatccttctaccccagccttccaaatagttagggctacaggtacatgccaccatgcctgggtaatttttgcattttttgtagagacagggttttgctatgttgcccaggctggtctcaaactcctaggcataagctatctgcccgcctcagcatcacaaagtgctgggattacaggcatgagccaccatgcctgacccaggatatacatttgataaaagttgaagtagtatacctcaagatttcctagtaaataatagtattggtaatttttctgcaaaagttcacttaagttgaattgagttattttagtgctgttaattaatgaaatgtatacttcattgaaggatatgtaatgtgggaaaatacagaaatcattttgatgtatttctttcccttagaattttaagataaaatgggacagatagacatgtcagtagttagttaagtatgatgaatggtagaatggcagaaagtttgataaatatcatgaatgatctgatgtagaaagatgaaaggatgactgatttcaacttggtattgggcctgagactcagaaagttttcaggtgattaatttccatagataaagccctaagagaagggcatttaaaacttaggggcaaataacccaattaaaaatgggcaaagagacatttctccaaagaaggtaaacaaatagcaaacaagcaaatcaaaacctcagtgagataccacttcacaggtactagatgactataataaaaaaaaatacaaaataacaggtattggtgaggatgtggagaaactggaactcatataagttgttgggagtgtaaaatggtatagttgctttggaaaacaatatggcagttcttcaaaacgtgaaacatagagttaccatgttgacccagcaattccattcctacgtgtatatcaagagaactgataacatatgtccatgtaaaaacttatatatgaaatgttcatggtaacatattcatagtagccaaaaactggacacaattgaaatgtctgtcaactgatgaatggattatcaaattatggcatattcatacattggagtattatttagctgtacaaaaaaatgaaatactgatataggctacagcatggatgaaccttgaaagcattatcttaagtgaaagcagccagtcaaaagataatacatatgatatgattccattagaaatgttcataataggcagttctgtagaggcaggaagtagattagtaaccaggagttgcggggaggagagaatgactgcaaataaataggtttctttttggaatgatgaaaatgttctaaaattagatagtggtgataggagcaaaacttgtgactattaaaaaaatcccactgaattgtacacctttaaatgttgaattttatgctatttaaactttatctcattaaaaaaatcttactaccttaaaataaagcatagagaacaacattaatcagagtatgtagatataaaacatacctttatttcacactagagggtaaatttttgttagacaatgcattgctgagacagaaacagtgtcttatacctggaacaaacataacatgtagaagatacttgatttatttttttccaacttgacaaatttcaaatatatggaaaagctgtaagagttattataaggtgaacactcacagacttatcatctggagtcttctattgatattctgttacaattgcttcatcacatattggttcatctaacatccctttccctatttatcaatacaattgtttttgatgcctttcaaattaagttacatacattgctacacttcacccctaaccctcagctgcctgttgttatctagagtttctactaagtggtgggtctttttattttttttggaggttaaatctccaaagtaaaattcaatgagtttgagaaatacatacacctgtgtgatgcaaaacactcatcaagatataggtcattaacatctgagatagtttcttatgcccctttctagtcattcccctttcacctgcctgcctccccgcgagaaaacactgttctgaagttccttaaaactgtagatttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctattctttctcttgggtaaatacttaagagtggaattatatgtttagttttcaaagaaacttccataacttttttcaatgtggttgtaccattttatattcctatcaacaatgtgtgagagttgcagttggcctacatccttgctaacattcaatggtgtattttttcacttttttgccattgggatgagtgtgttgtggtatctcatggttttttaatttgcattttttgatggctaattattttgaatttttaatgtgattatcggcctttatctgcctttgtgaagtatgtgttaaatatttgtccatttaaagcttttttgtgtcttttaaaaattttattttactttatgtatttattatttatttattgacatagtctcactctgttgcctaggctggagtatgatggcatgatcatagctcactgcagccttgaactcctgggctcaagcaatcctccagcctcagcctcccgagtggctgggtgggactacaggtgcacgacactgagtgtggctgataaattttgttttgttttgtttttggttgaggtgggggtctcactttgttgcagtaggctgttcttgaactcctggcttcatgtgattctcccatctcgggctcccaaagtgctgggattataggaatgagccagtgggcccaacagggtttgcaccttatataaaacttattctgaactacaatggcttaagtgtcttggtactgttattttagttactctagttaattcttattaagccttttccttctcaggtgaaagaaggtaaacattcataacctataaatgtagaatgttccaagagtctcctgtcataagagtttaaaaagttataaagctttttgagtaagaaaacctgtaaggatgttatttaaagatttaaaggagtatgtgtatttatagatttatcaatggagagtagatatgagtgaatatgctggagactaatttttccatggtgttttttttttgtttgttttttgtttttagacagggtccagggtcttgctctgtcacccaggctgcagtgcagtggtatgaaacatggctcactgcaacgcctgcctcctggattcaagtgattctcccacctcagcctgccaagttgctgggaccataatgggtgcacaccaccacacccagacaatttttttgtatttttagtagggacagggtttcaccatgttgcccaggctggtctcgaactcctgagcttaggtaatctgcccaccttggcctcccaaagtgctgggattacaggtttaagtcaccgatcctggcccctatgaattttacacccggacagtttttttgtatttttagtagggacagggtttcatcatgttgctcaggctggtctcgaactcctgagctcaggtgatctgcccaccttggcctcccaaagtgctgggattacaggtgtgagtcactgctcctggcccctatgaaatttttaaaaagtaatttttttttctaaatttcatgatgcctcttttgtttatattgctataattatattaaaggactttgatggagtttgtctttacaaaggtggcataaattaaagagtagttggaatctaaatctttggtctgccagtttgtaaccaaataaaatttcttggctataattttttcagctgtacaacaggaaaggtataacatatcttacttgctagtaagaaagaggccccaacattattatttttcttaactacatataaaagttgttttattctaatatttgctttcatttttgggataattcttgtttgggcaggggagcattttgcctagaagcacttgccattttttttttcctccatgggtgctgatcaggaaatgaagaatgtttcttgggtctttgtggtattatgtttctgagaaaagtcagtttttcaatatatcagccttatttttgagaggtaggttttttgttgttggtttaaaacattcatgagcgatgttaaagaattaatttattatttgtctttatcaaatacagttaaaagttatgtgcagttgataaactactttccacatcacattaaccataacctactaaaggagaaagatacggtacaacatacagaaagttgagagtcataatgctaaattattggtttcaaatagtaataatcactgtatcatttgtttataccttatattagaaggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaa

SEQ ID NO: 359 - DNA, 239644 bp, Homo sapiens
gggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtttcttcttacctacagaattctgagtaattgaactgattttcccaaggtcacagaacaggtccttcctagagatgtgaaagaattcagactttctacttgagcttagtactgagcttgtcctgggctatgctgccacttagccaaggaggtgaaggggatgagaggaggaagccataggaagggcatgtagcaaactcctcatagtatgactgttgcatgatttttaccatttctgcaagtttcatgtaatgtctctcatcagaatatcagatccagtgtctctcttcagaatatcaggaaactgtagggaaacatgtattgcttccttgtctaataacttctcatgtgcatgctagagctgacatttttggaagtgtgtcttgtggataagaatgaacagttattgagtgcttaccagggtcaggtgctgtgtgtatgtttcatcatctcatttaagggttaggacaaccttaaaaggttagtaaagtttttattcccattttgcagttaggttaatggagtcttgagacagtttgaccaagattacacaggtaagttagtggtagctccaaagctccagctttggaatctaattgatcagattccagagcttccattctaaacaatgtactaagatgcgtgtagatataatttacttggagggcgtcccagtattgtgaaacagtaggtaccataaaggttaatagtaggtgtttttttttttttttccaccaccaagatgagccctcaattctgtcttcaaagcaaattctgtcttcaaagcaaagaaattttggtctaatacttgagaaatagtccaactttccatagttgtaaacttactaaaatctaagtaaaatgatatcatgttatcatgatatatatcatgatatatataaacttgttcttattttaaaaataatacaaacatattaacagataatttggataatggataaaaagtaaaaaaaaaaaaaaaaaatctgccgggcgcagtggctcacgtctgtaatcccagcactttgggaggcggaggcaggcggatcaccaggtcaagagatcgagaccatcctggccaacatggtgaaacccggtctctaccaaaaatacaaaaattagctgggcgtggcagcgcatgcctgtagtcccagctactcgggaggctgagggaggagaatcgcttgaacctgggaggcagaggttgcagtgagctgatatcgtgccactgcactccagcctggtgacagagcaagactctgtctcaaaaaaaccccaaaaaaccaaaaaacaaaaatcaccacccactgcagtaaatattgctaacattttgggtgtatccttacaggtatttccttttagtttcgtattttccatacttttagttttaatacaaatacaacttatttagtcggaagaattatcctacaattcactggagtttttataaccttcttgagaatttagaagaactgttccatggagtagagatgctacaagtcttttacaagttaaattcttgaccccggaatcagattgtcctaagtttgatcttgccttggctgtctataactttggagttactacttatcctctgtaagcctcagtttctttatatgtaaggggttaataataatacctacttcagaaggttgttgtgagggctacataaaacaatgtctataatatacttaacactgtttgacaactgagaatcaagcattcagtcaataagtggaacctttaaataattaccattatgtttttgttgttaaaattttgcaattttgtaaataatgcagatacaagcatttcatgcatatgggttttatgtatctgagattatttctttaggatagagtcctgaatactttaatggattttaagtgcatagttcaaatttatacccatttataccccataatatgtataatagtgtgagtattggatattaatgctaaaattaggtgtgttcatgtacactcttggatattttgtgctaactgtactttgttttaatttttgtttcatttctgttgaggaatattttcccatgtttttgttaaattgatttatttttacttaagaattgaatattagatgtatttacatatttttaaaagtatactcagtatttttcctatcaatactatctacgattattgcatagctgctcttttccaggtgttgtgttagacatcagtttataatcctcacagtaaccttgtgaactagacaatattatgctcattttaaagatgagaaaattgaggctcagaaatgttagtacttacccaagtctggtaagtagcagagccagagtttgaatcctgatgtgtcttactccaaagcctcccacactacttatatactaagattttgtctgttaaaaaatattgaagaacatactaactttctgcttttcacatgtcctgcaaatacttttcactcttttattttggttgttttgacatataaaaggtactgcttaaaaggaggtagtcagattagactctgagttggtgacacttatgctgctttatgctggcatgtttgctccctttattacactgtgttgttctctgagaacagttcatcctggcttctccatgcccctgattcttgggcattgtatggatgtgagtttgtttattcagtcattctctgcatttttattttctcctggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctgaaaaccctgagggagaactgtccaagtgtattattgtttttctctggcattaggattttcccattcaaaggcaaaaaggtattgggattctggggccagaggaatggaaaatgaagcatcttctaggtctaggactgagaaccatttagcatcccttggcacctgagccaggagggtatatggatctgccaccaatgggtggacctaccagtgggtcttaagagcccaggggtaagtaataccttagctgtggatgcttggcctttccttgcttccagcttaattgggtattgtttttgattgggaaaataaatagctaggggtctttaagctgtattttggctggcactgctgttttagccttccttggttttccagtataccatgccagtgtgttaacctgtttattaatgtggtctgggacagtgtctgtatttttgactattagcaatttcaccagatgatgcttaaattgtagtagtgcccctattttaaccataatatctctttttaacagggggcctgggcagcttgatactactagaaattactgttggaagatttgtttctcaatttgacaaatcaaaggaggaataaaggatcttacttgtggctttccttccattcccataatggtcgtggactgggaggaaagttttcctacataagtagtaaggaaagaaactgaatttgtattgaaaagaaactgaatttgggtgcccatgacgtccagagttacctgggggctcctcagtagtaattacgatgttcctgaacaggggcagtgaggaagaccctgggtcgcttcagtcttcatctaatttctcttttgcactgctagagttttgccttattgaaccccttggtgggagcagggccagtcaatcttccagtgccaggggttgtaactgatgctctcgcatttttggcaggggactggcaggggcttaatatagtcctttatccaattctcgtttttcttgcatttgaagcaagagtctttgttgtgcagattatcagaggcaagccaaatcaaccaaattccaagtggctggtgtgctccatcaattcctgcaggcctgaaataggtagcctaggaattccaaataaatagaacacatgatgacttgttggaaattcgcaggaaacaaaataactattctcagaaccaaataaaagccttccactagaaactaaaaaatgtctatggttttatatatatgcatacacaagtaaaacccaaaggagaacaaatagcaaacaaatgaaaattagaagcaaaaacaaatagacaggaaaccatctctaaatttttcctacttagtctacccggggggctacagtgttacccagagccccccagaaaaccacataatgaatattttattcctgatacacaactcaatatccttaattccaccagtatcaccatacatactgtgcaatgaagaaattcactctaggcacatgaccagtaagtactccagtgccagcttgtttagtaaagttatacttaagtcatgtgaacttgaaaattgcttagacttatttacttaatttatgagcgctcctttaattataagccaatctgatagacacaacatataacagtaagtgtacatacaaataaacacatctagacatgtatacacaaacacaaatgaagatccaatagctttttaccttggaactctagccatgagatagcaatataagtccactggttttactgtttgacccaatgggtaatccagtgaaggctgtgaaccaaaatttcaggtcaagcagtttccatggtagtttgatttttaaaggccaaacctccccagactccaaacactggggccaaacagcaccaaaggagaacaccacatgctaaccaggccaaccctacttagaacagcagcacaaaagcctggatacatgcacctccatcccaccttcccattcaacagcaaactccagaattccaagcaatactgggccaaacagtattgcaaaagaatatcaagtttactgaatccttatttcccattactatatcaaacacacacaaacaatgactgcagcacagtccaactgctgcagcaacaaacaagccccaagagtgtccagactgtcccattgtcacctgtgagagaaaattccaaggaggcctttgtgctagacctcagaacctctgccgagggcgtcccctttggagaggttcaggtctggagttggattccccggggtgttcccctttgggatccaatcttagagtgtcagacgtctctgaccttagttaggcatgggtgctgctttgtatgttttccctccagaggtgatggcgtactatgaaatttgttttgtccctggatgaaagcctcaacttctagcatacttatgatttgataagaccatgctttcccttgcttcccgttccactagagtgttagccatgaactttaatgataggaaccggaggtgggtgcatttcttttgtccttagcaagtcagatagaataggagaaaggtcaaaactcctaagagacatcattgtttgccattactggttaacctataggataatttggcataagaaccctgtaggagaatttaacataagaaaacaaagtttaagtcacctgaaacgtgtgaattcaccctggatgagctgccatggccaactgcaacacacgtaaggatcatggactatagctggaaaagatagaaaagagtcctctccttccccctcctggtatgggcagctatcccccttggccttcaggtaacactggaaagtggccctggccagttgcccacaattatcagggagctactaggaaatggccactgaaagactgaaaaagaaaaaaaggaaaggactcaggcctctcacccaaactgggcggtggtggtcaggtgcttccacatagaaaactcttggtttcactggagtgtggccccggccagaaacctgcagttgcctctgtgcttaggcattgtgcgctgaagggcccaagttggaaagggaaaagagaaaaaagcattcccctgtatggagcagagaggaaaacgagaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccgcaaccaatcagaagctgaagttacaaatttacaccctatgcaaatgtctaattggtcatagaaagcaaccattcagaggctgaagtgaagttacaaagttatactcctatgcaaatgaagacttggcccatgactagcctgattggttgtgggaggggatcaatcaaaggtacttcgaattttttcatctgccacgcagaaaaggggcaggagggttgcaaagggagtggcttctggtccttttgttacttgggcatgggaagttggggttggggttttccttttgatttagttctaggaagtcagcatgagttggccttaggttccctgcctccagaccctattctgcctcaaaggaaagaaatggcaagctctggaatagaatatagtagtgctagattttttttttttttttaattaaatacagggtctcactctcttgtctaggctggagtgcagtggctcaatcatggctcactgcagtctctacttcccaggctcaggtgatcctcatactcagcctccagggtagctgggactacaggcatgcaccaccatgcctggctaattttttgtagtttttgtagagacagggtttcaccatgttgcccaggctggttttgaactcctgggctcaagcagtcctcttgctttggcctcccgaagtgctgggataaaaggcatgagccaccacgcctggctagtgatgctagatttaagctatattttggaagtaggatttgataggttggatgtgaaggatgaaaaaaaggaagacattgtgaagatacctcactggtttgtggcacgggaacctgggtggagggtagtgccgtttgctaagatggaaaagattagttttgggagccgacacaagaattcagtttgtgcttgttgaaaagctcaagaaactcaagtggagaactgatgactgttggatataaaagtcaggagttcagaggagaggcctggctgggttggagataaccatttgggagtcaccaacatataaagggggttttaaaaccacttagagattgagtagaggaactagcttaaaggaagggaagcaccattgtttcttgacagaagttaccaggtgccctgagatggggcaacccagggactctagacccagtctcttcaactttacagttttgttcctgtcacttttgttgtctttagttgacccttcctcatcctctgccaataccatttacttcctttcttatcatggatatgtgatacacactggtaccttacaaaggcaattgcctttatggatctttcatttcattttttttaagagaaggggtcttgctatgttgcccaggctgaagtgcagtggctattcacagccacaatcatcatgtagtacaaccctgaactctcctgggctcaagtgatcctcctgcctcagcctcttgagtagttgggactatcgtcacgtactactgtgcctggcccatttacattttaatacaaaatgttctgtccctgacatttgggttctccctcagtcttattttatgaagtagatgctggctaactcttagtagagtttagaataagatagaggtacatacctggtcaatagaaagggattcctggagaatagggtatctggatggagggtagaggttttgttggggaaaacaggtagtttcttagtatcctgttatttcatgatgtgaattagtgccagattgtttcattgacatcattcatcatacttcaccaggcatatactgattgtcacttgtgtgttacgcactgcgataaatgctggggtttctttttttttttttgagacagagtctcgctctgtcacccaggctggagtgcagtggcgcgatcttggcccactgcaggctctgcctcccagattctcaccattctcctgcctcagcctcccaagtagctggaactacaggcgcctgccaccacgcctggctaattttttgtatttttagtagagacggagttttaccgtgttagcaaggatggtctcaatctcctgacctcatgatccacccccctcggcctcccaatgctggagtttctaaggaatatgaggatgtgctgtaacacacaggtctatatcaataactaggcagtacagaggaaagccagtgccgaacgtattggcacaaccttcactttctgcaagtagtccctaattttctgtatcatagctgtatatttttatgtgtttgggtctaagctataaatccactcactgaccgtgtgctctgctcttggccttatttatttctggagattgctgacatttgcccttttcctcagatgctctatccctgtgggaggcttctctttccctttaacactgctgcatactgcatagttattaaagacctaccccatcagactgttgatgcaataacacctctcatttgcccccctcctgcagtttgtctttgaatgtgacattggtaggtcttttttcttagacatttctttctctttaagttgttggttaatatttttcttttagtttccttaaacgtttattgaaatagtgtttgcatgtgttcattcattcattcaacaaatatttatttagcacctattacatgtcaggccctgttgtgagcactgaagacacagctctgatcaaaagcatttaaggataccagtcctcttggagcttatgttccattatggtctttacattctgcctatatgtcacctcattttttcagcagtgctgatgacctgcatattcatgattctttacttagtacaatttcaattaaacaactcaatgccagccacagagccctgttttaacaataggcaaccattaacttgcatccttgatatagaagaaagtgtgctgctgtattttgttgttgtttgttttgctatacctttttatcttgaaaaagaattaccagtctggttttaaaatgtagcagtcatttattagtactgtgtgattgcataattaggtaactgtgcttaataaatttttagtgatgtatatagattattttttaacagtcttaccagcagtacagctttggttagcacatgctataagtaggtttatcttactatggcagacataagcatagtctatgaatagtctttgatgtaacctctaggagaataaataactctaaggaaaatatatattaaaaaaaattacctgtgaataacttgtgatttcttcttgccttgtccacaaatcatgctgtaactttaaaaaagaaatgaaaagtaaatgctgctccattaaaatttgtaatttaaaacttagaaaagtatctggtagaatagcaattaatccaaaaccctaaaattttgaatctgtttgaaaaactattcaggagtgaaagtttaggtattcacatggaaataattacctttaaatacccttactggtaaattattttatacaagacgaatagattctttgtggttatcagacaataattgaaatgtttactttgtatgatttttattattaaagtctttgcttcctccctactaataacttgctgagcatcagtgcaataagatatcatgtcattcagtattaatctgaatgttcagcagacttgaaataaatagcaacttagatatttagacattttgttgggaataggcccccaaatctggccataaactggccccaaaactggccataaagagaatctctgcagcactgtgacatgttcttgatgaccatgacacccacgctgcaaagttgtgggtttacggggatgagggcaaggaacacctggcccacccagggcggaaaaccgcttaaaggcattcttaaaccacaaacaatagcatgagcgatctgtgccttaaggacatgctcctgctgcagatagctagcccagcccatccctttgtttcctgtaaggaatacttttagttaatctataatctatagaaacaatgcttatcactggcttgctgtcaataaatatgtgggtaaatctctgttcgaggctctcagctctgaaggctgtgagacccctgatttcccactccacaactctatatttctgtgtgtgtgtgtctttaattcctctaacaccgctgggttagtgtctccccaaccaagctggtgtcagtacatttttattctggctaggttcttagctatggaaatcctcatagacaagtcaagatcttactttatgaaatgtatgcaataggagagtcagtgggatgtcactgtgattgggaaaaatgtttacccaagactattatcttctgaagctgggcaccaatatatacttgaagaatatttataaaatcgagaaggatttaaggaaagtacaggcctacctcggacatattgtgggtttggctccagaccactacaataaaatgaatgttgcaatatagtgaatattacaataaagtgagtcacacaaatgtattggtttcccagtgcatattaacatgtttacattgtactgtagtctagtaagtgtgcaatagcattatatctaaaagatcaatgtacatactttaattaagaaatactttatcgataaaaattgccaacaatcatctgaaactttggcaagtcataatctttttgctggtggagggtcttgccttgatgttgatagctactgactgatcagggtagtggttgctgaaggttgtggtggctgtggcaacttcattaaaaaaaaaaaagacaacaatgaagtttgctgcattgatagaatcttcctttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccacttttttttttgaattcatagaaagtaatagattccatctcaaggctccactttctttgagttcttcaggttgcatacgtaaagagcaactcctcatccattgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtttgagaccagcctgggcagcatgtgagacctgggctctactaaaaatacaaaaaaattagcaggcatgctagcgcatgcctgtaatccctggggtggctgtggtgtgagaattggttgatcctgggaggtggaggttgcaaaaaaaataaaatgaacgaatgaatgaatgaataaatgaagtcatccatgagggttgaaatcaatttatttcaaactcctataaatgttgacttcttttttactgttttttgagacagagtctcactctgtcacgcaggctggagtgcagtggcataatcttggctggctgcaacctctacctcctgggttcaagtgattcttgtgccttagcctcctgagtagctgggattacaggtgtgcaccaccatactgggctaattttttgtatttttggtagaggatggggtttcgccatgttagccaggctggtctcgaactcctggcctcaagtgatccgcaccccccttggcctcacaaagtgctgggatttcaagtgtgagccatcacgcctggccaatgttgacattttgaaatttcatgaaccatgaacattctaaatggcatctagaatagtccttcccagaagattttcaatttactttgcccagatccatcagagtaatcatttatggcagatatagctttacaaaatgtatttcttaaataataagacttgaaagtagaaattattccttgatctgtgaggcacagaattgatgtattagcaggcatgaaaacaatgttaatcttttttttcctattttttttttcattatactttaagttctagggtacatgtacacaacgtgcaggtttgatacataggtatgtgccatgttgttttgctgcacccatcgactcatcatttacattaggtatttcttctaatgctatccctcccccagcttcccaatccccgacaggccctggtgtgtgatgttccccgccctgtgtccaagtgatctcattgttcatttcccacttatgagtgagaacatgtggtgtttggttttctgtccttgtgatagtttgctgagaatgatggtttccagcttcatccatgtccctgcaaaggacatgaactcatcattttgtatggctgcatagtattccatggtgtatatgtgccacattttcttaatctagtctatcattgatagacatttgggttggttccaagtctttgctattgtgaatagtgccacaataaacatacatgtgcatgtgtctttatagtagcatgatttataatcctttggatatatacccagtaatgggattgttgggtcaaatggtaattctagttctagatccttgaggaatctccacactgttttccacaatggttgaaccaatttacactcccaccaagagtgtaaaagtgttcctatttctccacatcctctccagcatctgttgtttcttgactttttaatgattgccattctaaatggtgtgagatggtatctcattgtgattttgatttgcatttctctgatgaccggtgatgataagcattttctcatgtgtctgttggctgcatagatgtcttgttttgagcagtatctgttcatattctttgcccactttttgatgggtttgtttgtctttttcttgtaaatttgtttgagttctttgtagattctggatattagccctttgtcagatgggtagattgcgaaaattttctcccattctgtaggttgcccgttcactctgatgatagtttattttgccgtgcagaagctctttagtttaattagatcccctttgtctattttgtcttttgttgccattgcttttgatgttttagtcatgaagtccttgcctatacctatgtcctgaatggtattgcctaggttttcttctagggattttatggttttaggtctaacatttaagtctttaatccatcttgagttaatttttgtataaggtgtaaggaagggatccagtttcagctttctacatatggctagccagttttcccagcaccatttattaaatagggaatcctttccccatttcttatttttgtcaggtttattaaagatcagatggttgtagatttgtggcattatttttgaggcctctgttctgttccattgatctatatctctgttttggtaccagtaccatgctgttttggttactgtagccttgtagtatagtttgaagtcaggtagtgtgatacctttagctttgttctttttgtttaggattatcttggctatgtgtgctcttttttggttccatatgaactttaaagtagttttttccaattctgtgaagaaagtcattggtagcttgatggggatggcactgaatctataagttactttggacagtatggccattttcacaaacagattcttcttatccatgagcatggaatattcttccatttgtttgtgtcctcttttattttgttgagcagtggtttgtagttctccttgaagaggtccttcacattccttgtaaattggattcctaggtattttattttgtttgtagcaattgtgaatgggagttcactcatgatttggctctctgttaatggtgtataggaatgcttgtgatttttgcacattgattttgtatcttgaaactttgcagaatttgcttatcagcttaaggagattttgggctgagacgatggggttttctaaatatacaataatctcatctgcaaacagggacaattttacttcctcttttcctaattgaaaaccctttatttgtttctcttgcctgattgcggctagaacttccaacactatgttgaataggagtggtgagagagggcatccttgtctcgtgccagttttcaaagggaatgcttccagtttttgccaatttagtatgatatcggctgtgggtttgtcataaatagctcttattattttgagatatgttccatcaatacctagtttattgagagtttttagcatgaagggctgttgaattttgtcgaaggccttttctgcatctattgagataatcatgtggtttttgtcattggttctgtttatgtgatggattacgtttattgatttgcatatgttgaaccagccttgcatcccagggatgaagttgacttgatcgtggtggataagattttttatgtgctgctggatttggtttgccagtattttactgagaatttttgcattgatgttcatcagggatattagtctaaaattctcttcttttgttgtgtctgtcaggctttggtatcaggatgatgttagcctcataaaatgagttagggaggattccttctttttctattgattggaatagttccagaaggtgtcgggggaacccacccccaatattttaacgtaggttctttctgttttccataagtgtcatctggctgagaaataaagagaaagagtacaaagtgaggaattttacagctgggccgccgggggtgacatcccatattggtaggaccatgatgcccacctgaggctcaaaccaacaagttttttattaagggtttcaaaattggagggggtttaaaacagggagtaggtacaaagatcacatgcttcaaagggcaaaaagcagagcaaagatcacatgcttctgacctaacaggacaaaaggcaaaacagaactactgataagggtctatcttcagctttgcacatattgtcttgataaacatcttaaacaacagaaaacagggtttgagagcagagaaccagtctgaccacaaatttaccagcttggagtttttccccaccctaataagcctgagggtactgcaggagaccagggcgtatctcagtccttatctcaaccacataagacagacgctcccagagcggatgtttataggccttccccccctcccccccggcccccccaggaatgcattcctttccctgggtattaatattaatattccttgctaggaaaagaatttagcaatatctctcctacttgcatgtccgtttataggctctctgcaagaagaaaaatatggctctttttgcctgaccccacaggcagtcagaccttatggttgtcttcccttgttccctaaaaattgctgttattctgttgtttttcaaggtgcactgatttcatattgttcaaacacacatgttttacaatcaatttgtacagttaacacaattatcacagtggtcctgaggtgatgtacatcctcagcttacgaagataacagaattaagagattaaagtaaaacaggtgtaagaaattataaaagtattatttgggaactgttaaatgtccatgaaattttcacgatttatgttcctctgtcatggctccagccagtccctccatttgggatccctgacttcctgcaagaagaaggaatggtaccagcaactctttgtatctctggtagaattcagctgtgaatccatctggtcctggactttttttggttggtaggctattaattattgcctcaatttcagagcctgttattgttctattcagagattcaacttcttcctggtttagtcttgggagggtgtatgtgtccaggaatttatccatttcttctagattttctagtttatttgcatagaggtgtttatagtattctctgatggtagtttgtatttctgtgggattggtggtgatatctcctttatcattttttattgcatctatttgattcttctctgttttcttctttattaatctttctagtggtctatcaattttgttgatcttttcaaaaaaccagctcctggattcattgatttttttgaacggtttttttgtctctatctctttcagttctgctctgatcttagttatttcttgccttctgctagcttttgaatttatttgctcttgcttctctagttcttttaattgtgatgttagggtgtcaattttagatctttcctgttttctcttgtgggcatttagagctataaatttccctctccacactgctttaaatgtgtcccagagattctggtacgttgtgtctttgctctcattgatttcaaagaacttctttatttctgccttcttttccttatttacccagtagtcattcaggagcaggttgttcagtttccatgtagttgtgcggttttgagtgagtttcttaatcctgagttctaatttgattgcactgcggtttgagagacagtttgttgttatttctgttcttttacatttgctgaaaagtgctttacttccagttatgtggtcaattttagaataagtgtgatgtagtgctgagaagaatgtgtattctgttgatttggggtggagagttctgtagatgtctattaggtccacttggtgcagagctgagttcaggtcctggatatccttgttaaccttgtttctcgttgttctgtctaatattgacattggagtgttaaagtctcccaatattattgtatgggagtctctttgtaggtctctaaggacttgctttatgaatctgggtgctcctgtattgggtgcatatatttaggatagttagctcttctttttgaattgatccctttaccattatgtaatggccttctttgtctcttttgatctgtggaaaacaacgttaatcttatacatctccgtcagagcgcttgggtgaccaaggcgcattgtcaatgagcagtaatattttgaaaggaatctttttttttcctgagcagtaggtttcaacagtgggcttaaaatattcaggaaaccctgatataaatagatgtgctatcattcagggtttgttgtttcattgaaagagaacaggcagagtggatttagcataattctcaagggtgctaggactttcagaatggtgaatgaacattggcttcaacttcaaatcaccagctacattagccccttacaaaagagtccacctgtcctttgaagccaggcattgacttctctttagctatgaaaatccaagatagcatcttccaatagaagctgttttgtctccattgaaaatcttttgtttagtatagccaccttcatcaatgatcttagtgagatcttctggataatttactgcagcttctccatcagcactttatgcttcactttgccgttttatgtactgagatggcttctcttcttaaacctcatgaaccaagctctgctatcttcagatttttcttcggcagcttcctcacctctgtcagctttcatagaattgaaaagagttaggaacttgccctggattaggctttgacttaagggaatgtcgtgtgtgatttggttttctattcagaccactaaaattttcttcatatcagcaataaggctattttgctttcttatcatttgtgtgcttactggaataacagtttacattttcttcaagaacttttcctttgcattcacaactaggctatttggtgcaagaagcctagctttcagactctctggactttcagcatgccttccgtacttagcttagtcatttctaacttacgatttaaagtgagagatatgcagctcctcctttcacttgaaaacttagagatcactgtaggtctaattttcatattattatgtctcagggaatagggaagcctgaagaaagggagagataaaggagaatgactggtcagtggatcagtgagaacacatacaacatttattgaggttactaatgtaattgtcttggggtgccatggcagaatgtcagaaggctgtggcaccccaagacactataacctcaaagatcattgatcagagatcatgataacagatgtaatagtaatgaaaaagtttgaaatattgtgagaattatgaaaatgtgattctgatgctgatagacttgctagatacagggttgctacaaagtttccatttgtaaaaattgcaatatctgtagggcaaaataaagtgaagcacagtaagacaaagtatgcctgtatctattaagtgttatagccctagcctgaagaaaaataaatttttaagtaatcatggacatgtggtatgattgtatatcttttgccataagtgatataaaataatatttgagtaaattcgtattatctccaccaaatataagagtagaaacaggctatgattgtgggcacagagggcagaggacgtatctgactggggattgccaagacctgaaccctgggcattcagtactgttgaaaggatcagagagacattagatgccagagtaggcagaacgtcagaagtctggagtatcggtggataatggaaggaggaaagatgtcatatgtcagaacctgctgtggagcaatgccaggctagggaagaaaatgggtctccaggaaaaggacaagtgaccaatgtcccatggtcagacagttgaaggcaacagcagtagctgttgtgacccacactgggaattagatcttgactgttgggacacactaggctaatgaatagcatggaggttaggtgggcagtgatcagggtaagcaacaggtatcgaaatgatttgttatcagcatgctgtgggttaaggcgactaccagcgtgtagatcaggcactaggataaagagtgggcctttcgatcgggagatttaggctgaagccgttctgtgctctgaattgtaattttgcagaggagttgacttaaagttttgggatgactgtgggcattgggcagcacctgagcttgaatcgaagctctaatgtcatgatgtttctgaattctaacatttagaactttatcaaatgaagctttcctataccattcagaagagtactaaggtgaagatagaaggacatggacagagtccagaacctaacaatgaatagctaatatttattcagcactcactgtgtcaggtactgttctgagtgtattacatgtactgcttcatttattcctcctaaaaaatccatttagggaatggacactggctcacagatattctatttaagtaataagacaataagaaggactaaatatgatgtggttaggcataagattatggtatgttccaaactccagcagttccgggtaccaaagtttatctttacccttccttattgttttatggtccatgaccatttgctgttgacgtatttagcacatgccactggtcatgcacattccttatggcttaggttcctaacacctgtctgtgcttcttcccagaccactcactttgacgggtctccctttctgactttccataggtcttattgtctacacgcatttagtcacttggttatattccttcttcctgttttatacttttacaaaaaattgtttaatatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaagtcagctttctcttacagtgtgtgtggtcctgatattgtattaataacttctggattaaaacctgctgtgtactcctgtttctttggcacatagaagaaaacaaaataccttttcattcagctatttatttataaaatgaagacttgattttatgcttccctttggaatacattgtcattcaacttgtaatatgttttggaaataattgtaatatttatatataattttataagtatcttaatcttcatcttattaaatcattgatacaaaaccaattgttcttccactgtatgttttcaaatttgattggctttacttcatatatgtatatacatatatatttaacatatatctatatatacagtttatatatgtgtgtgtgtgcatatatgttgactatacattgggcttccaccttccacctgataatctgtagttttaaggttaaatgaaaaacaggttattttttagggagaagtgggagctggactaaaggatgattagatcttgatttgttttgaatgctacttgcggatgattgaactagagaagtaaattcaaacatagagaagggtgagttttttcttggggtcgataaaaactggttaggtacgtttatgagactagcattcagctctatgaataccccttattttaaagctcctgccaatttccacctacaccattctttgccttgcttactgtgtccttcgtgcttgcctcctttctgcttcacacagtctaaatccctttcctatttgtgactgttcccttagcttggaatgctcttctgatggcttacttactgtatgctgtgtctcaggaaaaaccacaggcctggaagtctggagcatgagtcatagttctgcctctagctttctgacttggccagtcaatttaccacttctctggtctcgttttcttcatggataaaacaaatgagattctagatcagtggttctttctcaactggggatgatcttagtctccactcccacaactctgtttacatttaacaatgtaagtgaagacactttttgttgtctcaactgtgtgtgtgtgtgtgtgtgtgtgtgtgtgtgtgtggtaactgtcatccagtgggtagagaccagggttgctgctatgtatctacagtgcacaggacagaccctcacaacaaaagaatcatctagtctaaaatgtcaataatgtagaagttgagaaaccttgatcgagatctatggtccatttatcttttgtgatttaaaatgtaaacatttaaattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatgcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttctgaggttatgttatacttaaatccaagaacccatacatgttccatctcacttattgggaacttccagcttagtcttttcttttccatttatagcaggttgagtttctggatccagtccgtctgctttctcctacttctaatacctgcttagagcttgaggtagttgggcaaaagattatttttcctgatcatttagactcctgctacaaacttttagatctttaataaacagttaaaaatctttacacatttgatttcaaaagtaatgcatatacattgtagaaaatttggaaaatatagaaaagcataaagaaaataaaaattgctcatgttttcagagataacttggagataaccactgtacacgtcttggtatatatacttctagactgtatttgaatatgtttgtatatattaactaatatttcaaacacagaattatacttctgtaactgagtcttctctgtatccagtataactatgctgtggagcagtgtctagacctcacaattccatcttgcctgactcagtgtagtagcatgccatgtgctttctgaatagctaatatttattcaactcactgcgtcaggtactgttctgagtgtattacatgtactgcttcatttattcctcccaaaaaatctaggggtttgtgtaggctgttgagtcctctgctgcctgtctgcccaggttctcatccataacactctgcttaccccttctgtctggggcattttatcgatgccatctgctgctcatacactggtgactcctgaatttctgtctctagttcagacttccgttctgagcttcagatctgtgtattcagtttctactgcacatcttcacctcagtgttccacagtcacttcaaactcagcatttccacacctaaggctgctacatgcacccagcaaatatatgcctcctagtgcatttcctattttggtgaatatatcaccatccatttagttacctaagccagacactggggaaattctaagtgtcttccttctttctagttccccacatccagtgaagttgtataattatatctaatctggcccctcctttccattcttactgccctgatacttaagatctttcatttttctctgcctgcagagttttatttcttttcttagcagtcaccactcctttagtcttaccctccctccaatccattccctatcttgttgccagtgtgatgattttaacatgcatatttcttagcaggacatacaaaatacttttttttttttttgagatggagtctcgctctatcgcccaggctggagtgcagtggtgcgatcttggctcactgcagcctctgcttcctgggttcaagtgattctcctgcctcagcctcctgagtagctgggactacagccgcataccaccatgccctgctaatttttgtatttttagtagagatggaatttcactgtgttggtcaggctggtctcaaactcctgaccttgtgatccacctgcctcggcctccctaagtgctgggattacaggcatgagccactgcgcctggctaccaaagactttgagaactacttaggtagctacctgacctcatctgcttttatttttattttatttattttatctattttttagtttttactctacagacctaggaacttgagctttttaaaatttttattaaaactaatgttgagttactggttgtttctcttaagccccctgttgttttttcttctctcttcctttgcacttgctatctgggtctctctaccctgtctgattacctggtagactcctatttcttcttcagaagattcccctgtgaaactcttccggaccctccaagcagactcaggcagttctttatcactattcacgctgcaccttttaaatcttgaaagttgtactgtaatccataactcccaccagaaagttgtcaaaggcagcagatctttaagctgttccacagaatggatccctaggacctaatattgtatcaggcagtatttatgaagtgcgtgctgttgagtgaatttaccctttgctctcacttagacagtgtcctactgtctcaggaaggggatttccctctctcacattaattatttaggttggtctgattttattttccttaaaaaataggttaaaatggggagaaactaactcttaacttgaaaaagtccagtgctcttagagggtacctgcaaatttatgtttcctgtcatggcaggaggctgagctaactaatggctaagtaactcttttagctttattgtcagcagctgctgtgaatttttacaatagttttagggcagtgaagttacactttattaatttcaggttgaggatgttgatcaagatgaaaaattaaatcgctgatactttctaatgagagtaagtgagcttctgttttcagaagtgaagaataaaggaaagggtgaagagaaatatattaaaatacatttttcttgcatatttaaaaagtaacatatacttaaaaaattatctgcccttttgaatatagggcaggaatttttagctatacagaagcataactgtctgcttaggatttttaaaggataatttgtatttaaaataactaaaagattatgttgatatagttcaatataacaatcaagtcacactgcattaaatgacatagcaaagaaaacccttgtgccagatcagttcgctttctggggagtgctgaatgttgagtgggaaaggatcaagtcagcaggtggcagcctaccctttgaaatgagaacatccctgttggcattgtgccagcacttgaactgctgcaaagcattttatattccatcagaaggcggaatttgaaggattgtgggttactgacatacgttgtaaagctgaatactacttgatatgacaaagaaggaattgcataattagaggcaatgctataagaaaaggaagagaggcatagagcattttgtattccagacgatccagatgagtgtggatttagtaccactaaactgcttctcttccttgtcctttgatagaacaaaatagtatgagtgctttgaaaattagaagaaagaaaatagtatgtcctcatcaacattgcattccaaatggcagctttaaccactgtacgtaatgagatgtattgattaggagcaacagctggacctctggggaagcagggagtgggagagggcagttaaaggtagttgatttgtagggtatgtgtgattttatgttgaatgccacacatgctttctttctttcttttttttttaagacagagtcttgctctgtcacccaggctggagtgcagtaatgcgatcacggctcactgtaacctctctctcccaggttcaagcaattctcctgcctcagcctcccaagtagctgggactacaggtgcccaccaccacacctggctaatttttgtatttttagtagagacggggtttcatcatgttggctaggctggtctcgaactcctgacctcaggtgatctgcctcccttggcctcccaaagtgctgggattacaggcgtgagccactgtgcctggtgtcacacatgctttcattcatataagtaatgagacagattcctcatggcatataaaaaatccattcgtattgtcattctctgagagagagagaaagagaaagagtgtatgtgtgtgtgtgtgttattaaaataagattttggtgtgtcaggtttaaggtatgtttgtaacattattctatactgatataacttgcctggttgtggttcttagtgtatatttggcccacttattggaggaaatttaggtgaggaaaggaatagctgaggacctcctgaattagtctacaggcctaaacatgtgccttttcatgggacttgatgtttttccattactgtatccattcctttacaccacaggtgtggcctgtcatagcagcttgggaaaactaatataaccacttacttgttttcttatgtaaacatcactgaaattgtataaccagatactttaatacactgaagtcaggttggaaaactaggacaggcatgcggtgaaggcaagtttttgtctataatatatcaatatttgggagttgactttgggcctcagtatcctcatcagtaaattgaagggaaaggactaggtggtcctctgggattcttccagagcatacatttaggtaagctttatggttttatttgtttttaaaaagaggaacacagttttttcatgctttgattccctttacatttagaggtttttttgaatatagttgttatagcattttggaaccatggggtaccttaggcatttaatttaattttttcttaagatgtcccttttccagcgttttgttttattttatttatttatttatttatttatttgagttggagtctcactctgtcacccaggctggagtgcagtggcgagatctcagctcactgcaacttccattccccaggttcaagtgattcttgtgcctcagcctctgagtagctgggataataggcatacaccactatgcctggctgatttttgtatttttagtagagatggggtttcatcatgttggccaggctggtctcgacctcctgacctcaagtgatccgccagccttggcctcccaaagtgctgggattataggtgtgagccaccacacttggctgcttttccagcataagttttaaatttaggggtgttagcaaaatctttgctctcttatatattttttgtgaattatgaaattaatgtctttaacagagaaagtgatcttccattatatgttcttgttgcaaagaacgggttatttgggtgatactcatactcttggatttagtgtcagggttccattgtagaatggcaatctgtgagatgggggtttggtttctgggttgttgaaactaattttatggaagaaaaaaacaggataaaattcaggaaaattccttagggaaattgaatatgtagaggatttatttcccctattgaagtatacatatttatgacatacaagcagattgaataccagatatagattgtgagatgtctaacaggaatttggagtgaaaacaggtattaataagttggtgtaaatctggtttcctaatatatttattaaaaatatttttaaaggattgttagtagctttaaattgctcttgatattacaaagttcttttgttttccaaaggtgcacatgttggcagaactagatgaacatgtttaatatgcctttttttccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactgttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggactcacagttctttttttcaaaacttactgcaaagctgtagttatcaaaacggtgtgacagtggcaaaaagacaaacattgatgaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccatatacaaaaatgaactcaaaatagatcacagacttaaatgtaaaactataaaactcttagaagaaaatgtaggggaaaagcttcgtgaaattggatttgataatgactttttaaatatggctctaaaggtataggcaacaataaaaatagataaattggactgcatcgaaattaaaaatatgtactttgaaggacactattaacagggaaaaaaggcagttcacagaatgggagaaaatacttgcaaatcatgtatcagataagagattaatatccagaatatatggagaacttctaaaactctacaaaaaaaaccccaatcaattaaaaaaataagcaaaggacttgcatagacatttctcccaaattgataatttatatataaattaccagtatataaattaccagtgaaaagatgctcaacatcatcaattattaggaaatgcaagtcagtatcccagtggaataccacttcgtactcattaggatggctgttatcaagaaaacaggaaataacaagtgttgctgaggatgaaattggaatcattgtgcattgttggtgggaatgtaaagcgacacagccacagtggaaaacagtacggtagttcctcaaaaaattagaatttccatatgatgcagcaatatgcctttctttttatctcatttaaaaaatccagctgaatgagttagcatagaaaatggaatggaaatattgatgcatgcttcatttactttagtttttcttatttattactttgatgaccttttgtgatttttccaaataaggattttagacactactaaaattagaatgggtacaaacggtcactgtattttactttctctaatttataacactgacctctcagaactttagttctatatgacgtggatatagactagataagaatttctcagcctgtcagcactatttatttatttctctatttatttgtttaagagtcagggtcttgctctatttcctatactggagtgtggtggtacaatcatacttcactgcagccttgaactcttgggctcaagcagtccttccgcctctcacagtattctcactgttggcttgttgaccagtggcttaacaaataccatttaagaaaataagatatttaatatattttgtaggatatcagagctggggagaaatggagggtatatctagtctagtggttttcaactgctggtgattttggcaatgtctagagatatttttggttgtcataccttggggggtaccactagaatctggtggatggagacctagaatgctgctaaacatgcacagggcagccccaccaaataactgtccgtaccaaaatgtcaatactgttgaagctggctgggcatgatggcttacagttgtaatcctagtgctttgggaggccaaggtgggaggattgcttgaggccaagagtttgagaccagcctgggcaacatagcaagatgaccccacccctacaaaaaattaaaaaaaaaaaatagctgagcagggtggcacacagctgtagtccacctgctttggaggctgaagcaggagagcccaggagtttgaggctgcagtgagctgtgatcataccactgcagtctagcctgggtgatagaaggagacccagactctaaaaaaaatagtgcagcaaggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcgtcatctagcattaggtatatctcccaatgctattcctcccccgtcccccaaccccacaacagtccccagagtgtgatgttccccgtcctgtgtccatgtgttctcattgttcaattcccacctatgagtgagaatatgtggtgtttggttttttgttcttgcgatagtttactgagaatgatgatttccagtttcatccatgtccctacaaaggacatgaactcatcattttttatggctgcatagtattccttggtgtatatgtgccccattttcttaatccagtctatcattgttggacatttgggttggttccaagtctttgctattgtgaatagtgctgcatgtgtgtgaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccagcaacagtgtaaaagtgttcctatttctccacatcctctccagcacctgttgtttcctgactttttaatgattgccattctaactgctgtgagatgatatctcattgtggttttgatttgcatttctctgatggccggtgatggtgagcattttttcatgtggtttttggctgcataaatgtcttcttctgagaagtgtctgttcatgtccttcgcccactttttgatggggttgtttgtctttttcttgtaaatttgtttgagttcattgtagattctggatattagccctttgtcagatgagtaagttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcttgaatggtacttcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatgtctctgttttgggaccagtaccatgctgttttggttactgtagccttgtagtatagtttgaagtcaggtagtgtgatgcctccagctttgttcttttggcttaggattgacttggcgatgtgggctcttttttggttccatatgaactttaaagtcattttttccaattctgtgaagaaagtcattggtagcttgatggggatggcattgaatctataaattaccttgggcagtatggccattttcacgatattgattcttcctatccatgagcatgaaatgttcttccatttgtttgtattctcttttatttcattgagcagtggtttgtagttctccttgaagaggtccttcacttcccttgtaaggtggattcctaagtattttattctctttgaagcaattgtgaatgggagttcactcatgatttggctctctgtttgtcttttattggtgtataagaatgcttgtgatttttgtacattgattttgtatcctgagactttgctgaagttgcttatcagcttaaggagattttgggctgagacaatggggtttctagatatacaatcatgtaatctgcaaacagggacaatttgacttcctcttttcctaattgaataccttttatttccttctcctgcctaattgccctggccagaacttccaacactatgttgaacaggagtggtgagagaggacatccctgtcttgtgccagttttcaaagggaatgcttccagtttttgtccattcagtatgatattggctgtgggtttgtcatcgatagctcttattattttgagatacgtcccatgaataccgaatttattgtgagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgtcagtatttttttgaggatttttgcatcaatgttcatcaaggatattggtctaaaattctcttttttggttgtgtctctgcctggctttggtatcaggatgttgctggcctcataaaatgagttagagaggattccctctttttctattgattggaatagtttcagaaggaatggtaccagttcctccttgtacctctggtagaattcggctgtgaatccatctggtcctggactctttttggttgataagctgttgattattgccacaatttcagctcctgttattggtctattcagagattcaacttcttcctggtttagtcttgggagagtgtacgtgtccaggaatttatccatttcttctagattttctagtttatttgcgtagaggtgtttgtagtaatctctgacggtagtttgtatttctgtgggatcggtggtgatatcccctttatcatttttaatgcgtctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggttgttctggggttggagctacttctgtaaccattgttttcaatttaattgattacacaataaatgttagagctaccaacaggtgttctctttgacattttaagtatcagtcagaatgtaatgaccttaagccagtttttctcaatcttatttgacaatggcatgcttttaaaaatgttcaaatgtgagcaccaataggggcttggaagataggcttggattaaagtgaacaaggaaaaatgggattatagataattattgtcagaaagtataaaattgattcatgtatcttttaagcatcacaagaattagaaaatgagaccatgtgtattttattaagaacaatatgtattagaaaagtaaaagatctttgttttatattttcattatcaaatatgacatccacatcctcaagccacacatccacgtaatatgaaagatgttgctaaattagtttcccaaacctgattcttagtcttctgaaaattctcttctagactggtgcctttaacagggggaggaacccagacatttttttcccttcagtatttagaatttcttgaatgagtacaccctagatattttaattgttttatttttgacagctcagtttctaatttttgcacatcaagaccagtgaattttcatttcttatgtatttggagttgcttgttttttgattcagatataatttttggattacaagcctgttcttttgctttaaacttcccatttcaaccatagatcttgaggaaatctatgtacgtagttgaaatttattttattgagtaataagtgttagattataaaatcaaataaaatacaaatatatattgaaattttaagagagtttaacatataatgttatccactaaaaagatgaattatgttaatcctaatatgagttataaatactgtctatctattattgctcaggttgaatgtcaggtaatgtgtgacttgctgccattcctaggtatagctgacccatacgtaaaggtagagtagaacatagaactattaagtactatagctatatatttagcacttttctttcagatctaataataccttttagaaggccataggagtccctttgggacacaggaatgggaataaaaacatataaaaataatacaaagttggggatttttacacatttgaaaaatacagtagtgcttactctgactctctctattcatgcttttgattaccatgctgcaatattggctgtgttgggggaggaggagtattgaaaaacattttgcttttgtgtttctttgacctaactttaagactattaagtttatttatcttttgtcagagtcatttttcttttctaaagaaaaaccacatgcagtgaaggaattaaaaatgggcctgctgccactgctattttggagattcttagattagcttagatcagtccagttatgaaaaaatttttttctctttcaaacagtgccgcatattccttgatttcaatttctcagaagtctgggagattatcagtgtaacatttctaccaaatttctcaaaattaaaaagaaatccagtgaagagtatcaataaatacagacaatttagattcctaaaattatcagggctgaaaaaggatcagtataacaattttatggagcagttcagattggtcaatatctggggatgcttggattctcccatcctgttttgttcatcttaaaacagatcacaaagtccgttaaatttcaactgctcctctttctaggagttgcatgtgtgatagccatagcagctgtatggcaacttcacgttgacactgtgctcagacattgagttgatattgtcacttacctgaagtcacttaactgtctcaggaagtttgaatctaaatgtgtaggttattacacagcaatacattctgtgcctctaattctgtcttggaaatccactgttatcacctttaatgcagttataaagtcacataatcataaagttcactaggaaaagttattttccagtcagactaggaggagccaataaaaacagctctacgtggaggacagtattaatgtcatttgccagatatttgttgagtgagactgcctatgcaaaagtcatagagaattagagcacagtgctttgttttctgttcccatttaacatagatgagatttctcagttgctttgattggcagagttgatgaaggatcagttaggtaaaggttggcaaatgtcatgtgctaagaaatcacttgtgaagcttgttggacaaaaagttttcagtttcctggtgagcagctacacccaaaggcggctttagcagtgaaatgcttgaccttctcttgtggcatcctgccatccttcccctctagatcctctggccaccagccagaagtggtggcatctagccaatcataaattagtcagaggattcttattctgtaatactggctcttggaaactctagtatctttagtaataaggaatttcttctccgtttctgggcatgctgttcatttaacccatcttttctgttttctggtctttgccagcttggagtctagcagaaacaaagaaacttgtttctaagccaaaaggaaacacacaaacctagtagtatatccttaatcaatatcctatagacaatgaatttgagcatttctttctttaaaaaagtggatgttcctcaaaactcaaaaggaaactcaaaatcacttcaggaacatcttaattctgtattcaacggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacattgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttcagttttatctttgtagatccccttctgctattgtttgtgtctgttttggtttctaatttctgccaaactgctaagggatttgatccaactgttagcatttgatgtgttttttcccttccagatcacatggactctatctttctgttgtgaatctctcttgtggaggctttagcagttagttgggcagggtcttgccttgcctgtcctcttctttattgtgcacagccatgagtggactgttgtccatcctctggagcatacacacaaaagcctgtgttgatggtgcagtaacaacatatggatcagtggtccttgcctttgctaacattgtggtatcaggagtgcttgaggggactttcccccaaaccacctcatccatacatcaaatctaagtaaaaacaatgggcttgctatgaacatgtaagtttaacacaagcccactggcttttgtttccaactagaatggttctttaagctgctcttatagatattttggagcttctgctgcctggcaactcaactctgtcagtttcatttagttgggtcagttttatagtttctgcagaactggaagctggccatttaaaatagccttggttccactgacacatgtgatgtgattgctggaccaactgttcacaagttgtgaagagattacaagacagtagtgggctgaaatatgctcagtagagaaaggctggtgttgactgataccattaccacattgaccagtgggtacaggaagtaggtagttactgttgaagtataataaacaccaccaggctttgtctaggctaaggcacttctttagtatgccctgggatctcttgggttattttcctggttacagagaccaatttattagctctaagagcttgttggagatgccatcctaggaaggtagatgccttccagttgtgtgtatgtgtgtatatatgtggaataaatatttgaaatgggtttcagacagctacaacactgtttgcttcacagcactgcttccctaccttgcccatatgctgcaatactgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgacagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaaggcttaggaattggcaacatcaagtacttctgggaatagggatgaatggagtggggctttagaatagggagaattggttgaaaatctttttaagagcccctcagatctctagcttccctctaccacctggaagaatctggaggttaattctccaaggagaatgtattaataaaatacatctagagagaaggaaggctgggaaatgtagtctttgttctgtgtggacatgtgctcagctaaagctctggggttctgttactgcgggagaaggggagaataaatactgggggacaattagcagttggcactatgcttacatacacacatacttgctacattaatataataatattgataatgatattgatggtgataatagtagcagcaaagtcttagagtgctttttacatgcccagcactgttcttagaactttacatatattaactcacttaattctcaacaatcctgtaaagttagttctattcttatcccactttgcagatacagaaactaatgtacaaagaggtaaaataacttccccaggtttcacaactgaaaccaggcctgagacctcatctttctgtgattaaacctgacattgtgattaagtttgaagaaactgattgctaattaatgttgttcattgtattggttttgtgttctctttgaagaaaatagtagtgatatatgtgctcaataaatataaggagttattgctatttttataaaattatatgtttgtacaaattcaagttgcattagattacaaataatttaacctttgatgtctattaactttttatgtttaaaaaaggttcatacattttgaagacaatcagagaaggtggtaagttgagtgattaaattgtaatttaaaacataactgtggtcacagtgtagagaagctgagactaaaagcagggagacgggggtgagatgatgcctgagtccaggcgttgtgaccttcggtgtgcgtcagaggcccctggaatgcttcttagatcatagaatgctggatttcaccctcaagatttctgatttagtaggtttgagatggggcccaacaatctttactgctaagaagtttccagaagcagcagctgctgcaggtctgagaaccacagcacctatctgagaggtaatgagagtctaaattgtggtagtggagggaagggataggtgatgaggcatcagtcagggagaattgacaggattgtgattctttgaagttgaggtgaatggagaggcaaggatccagagcagtggtgaggggttacacattgaatgaaattcctgttggttgttacaattaggaggccattggtacttgctgacctcaataaaagcaattttcatggaaaagtagggtcagacatagattagaaaactgagattttgaggagataggttaaatcctgtaatatattgtagaatacatttagatttctttagttctgaaatgcttgattatactctgtatcccagcttattttagcaggccatctgatactgaccaaactaatgcttccattgtcttcatgatactttctggctttccactcaccttttgcttaaaagtggtcctgacatttttaagaagtgtccatatctactttatttcaagtgaaagtcatccttctgcatatatgcttattagtttcagatcagtgtagaaacctttctgcttgcattttcttctgtatggtgacttttgagctctttctcttagatcctgcttttgggtcctcaaaacagctcagatttaagacgtcagagctgtcaagctctgctggttttactttggggtttctttcactattgttcccattgccactatcatagttcatgctcccagtacttttgatctgaatgattatagcaattatcatgagtctttgttctcactctccttcctagtcttatttaatttaaaaatatctgtgagattgattttccaaaataaagctctgatcataacacttctttgcttaaaatcttctcagtgtttaatagtaaagtccaaataagcaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaagcctaggcattaccattcaggacataggcatggacaaggacttcatgtctaaaacaccaaaatcaatggcaacaaaaaaccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaaagaactcaaacaaatttacaagaaaaagacaaacaaccccatcaaaaagtgggcgaaggacatgaacagacacttctcaaaagaagacatttatgcagccaaaaacacatgaaagaatgctcaccatcactggccatcagaggaatgcaaatcaaaaccacagtgagataccatctcacaccagttagaatggcaatcattaaaaagtcaggaaacaacaggtgctggagaggatgtggagaaatagaacacttttatactgttgctgggaccgtaaactggttcaaccattgtggaagacagtgtggcgattcctcagggacctagaactagaaataccatttgacccagccatcccattactgggtatatacccaaaggactataaatcatgctgctataaagacacatgcacacatatgtttattcacacacatgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagaacacatggacacaggaaggggaacattacactctggggactgttatgggatggggggaggggggagggatagcattaggagatatacctaatgctaaatgacgagttaatgggtgcagcataccagcatggcacatatatacatatgtaactaacctgcacattgtgcacatgtaccctaaaacttaaagcataataataataaaaaaaaatagtaaagtccagttttcatagcttagtataagacttttgtttctagcttcaagttttttcccccatattcttggctgcacccacactacccaccagttgtccccagtcttctctgcctgtctgccttccttatgctgctctgtccctcagaaggccctctctttccacttcaaatccaacctctattctggaccctgctcatcttcttatagcccttgctatctagaattccttttaactattgtctatttccatctagtactgtacctgtaactcagtatacttattttcaaccatgtatttacttatatataatattcaccttcttgtctcccacgatgcccataatagtgccaaacacaaagattggttgaatgaatgaagaatgggaaaccagctaggatatagtgcaaataaaggaaataaaatgatgattcatttaactgatacagtaaatatattgcatatcagtgaatgatgtctaatggaattttctaaagctaatatgagtgacagtaggaacctcttttaagtatagtcaatcaagtttgtcatcttttttttttttttttttttttgtgagatggagccttgctctgtcatccaggctggagtgcagtggtgcgatcttggctcactacaacctctgctttctgggttcaagtgattctcctgcctcagcctcccaagtagctgggattacaggcgtgcaccaccacacacagctaattgttgtatttttagtagagatggagtttcaccatgttggccacactggtctttttctcctgacctcaggtgaccagcctgccttagcctcccaaagtgctaggattacaggcgtgagccaccacacccagcctcatcttttttgattgttcagaaatcttttttatttaacttcttagcttttaattgagtcctagatatttcagtgagctgaatactgtccttaatatatgtgaaatgtcactgttatattatgccatttttaataagcttgttaagcatcacttggatgatacatgtgcatatatgtgtacttattcacacatgaattcacatgtattttacctaagattaatatgggccaactgtgttttctatacaatggaatattattagatggactaatggattcactagcctgattaatgatctgtaccagttaatttctgcgttttgatacatcttattgatgtgttttctgattctatttttatttactcattggagtgtgaactagaaaaatactatacacaagtaattagattgtagaagtgatgtgtaagatttgtttgttataattgattttagatgcagaaacatttagagctagcataagaaaagttgatgtaagttatgaaaattagaaaacatttcagatttagaatataatgatattatttaatttttaaaactaactttttttttttttgtttttttgtttttggccaaacattaatcatttggggcttttaaactgtattgcatttgggaccgcctgtatgtgggcctttagttagttccagtagcagtgagactcagatattttgaaagaacaatatcagatatagttagtgaatattgcttattttcaggttaaaactgattcttcattctcttgagctttcttttattaataggtcctcagtttggacttagaattcatttaatgtcaaccttctcttgtttacaaaggggaaagctcatttatttttcatgctttgtcatattgttccctttgtttctgagaaaagggcaccagcctatttagatagagcagtttaggctatttataaagctaggcaggttaattgaaattgacagcttggtaatgtcctccttggtgaatgacgcacaagggttttagatgatgttggcatgctgttttcacttatagtcaggaatcagctggaggaatttgtgtgctttgagctctggtgttgacgtaggtactgggtacagatatgttttaggaaacatctcatttccatataaatgaaggaagattaaaaagaaaaatttcaatggcttgcccttaaattgaagctggtatcacaaggatgatgataatacttcttttgattttctggaaaaacagctttggttgtattcaagcactgtggagtcgttacaggtttattcagaaatatttttgtattctttttttttttaatctgtttattcagcatcagctatgtgtacattaatttgaaaaactacatttttattgtgtattcctccaaactccaactttaatctcttaggttttagattgctccatttaagaaatttgtacaggtacataaataaacttgattttaataaaagatagaagactgaaatagtttttctttcttacatgacaagactgttattctttcttttttaaggacatagtaaatatcagtttgcctgaaatgagtttttgtgtttttctcttcaagtgtcacttaaaggagaggctaacaagcttaaatagtcacttaaatgagagtttaatttaagcttaactggttatgtagtcatattccctgacacccaaacatttaggtcataatcatttgtttcattcatgacagggtgatttccaaagtacagacattttatctcagaatcacattgagcatgcacggaagcaaattttagcttacataaagttaagaaacactagtagttgatttattattagttgtaatatatcttctatgggcccatagccttatcaaaactagcactgacaattcctgaagatatctggggctcttggcatggtgagttggtcctgtacttccaggttcatgctggtacctttgtggatcatcatgtctgtcatatggaccttagtcaaatgttatggcaaacagcacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgagcacagtacatgcctagtgagatcttccagctgatggtctgggatccttaaagaccatgcaacgtcctcagtacttctcagtgccaattgtcaggggatttttggctgccacgtgcctctcaactaacaactattaagtcctgttggttctatagtgtttctcaaattctttcttcttcttattttcctcaacactatcctgataatagcattatacatcttataaaatgctttatggtttgcagagcacttgaatgtgctttatcttatttgatcctcagatcagctctgattgatagccaggttagttatttttatcctgattttgtggatgaggaaactgaagcacaatccaacaccacacaactggtaaatggtggaaccagatttaaacccatgtatcgtgatgccagagcccatgcttttaagcactgtagtaacttgcttatatacaccaaactttctatctttatctcccactactgtttttaatcctcttatacttcagccttcttggtttgcttcccaactcagagtttgcccttatttcctgcctttggtcacactttaccttctacctgtgcctgtcgaaattctgcccattcttcagtgcctaattcagtgtcttctttttcataaaactttgtatgagtcctccaagcccaaaagaattcccctctcctctaatagcattttatttgtatgtcattttcttacatcataattatatttgacttatcgcattgtaagttgcgtgaggacagatggtgttttatttatccctttatcatttgtagcaactaactacagtgctttgtacatggtcaagtacatatgaaacaaattatatcaagtgatattttttactgggtcagaatcagagcctctggtggtggcaagaggtgatttgagagagcttgatactatctcttacaacatctatctaataagattaggaaggtatatttgagagactattatcttcagtttgctccccctcctaggacacaactaattcattaaagatcttatctaagttgtgacaaacagcactttgttcatcttaagataatttcattccaatgttccatatttttagtagtctctaatctagtaattgataatagtaattgaatttcttggcaaacaaaagaagacctaaattttaggtatcaaaattatttttattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggagattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaattttaggacattgtcctcaaagacttattacattcagattagctatttaaaactgttttgtatttgtggctgtggtgccagataacaaggtctaatttaatatattttagcatttgtgacttgagtagtttgcaagagacaatgtaggaaataaatttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtgggattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaatttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaatagagcaacttgtaacaatcattagaagtaagtgtatcagtaagtacaaaaagaattttctatacttgcttctagtgataattgaataaggcacacatataatgcagaattcaatatggctgtgataccaaccatatctttaagtgacttccttaaattagtgttcaaggactgcttgttagtggttttgtttggaacgaggtctgattatccttaactggttaaggaagccatgaggttatcagtactgttgtgtacagtgcatttaggtgaataggtattcttttcattagaatgattaaagtaaaaacaaaaacagaaagagattaaatatattatcaaactcaaagctttgttggtgttgacatttcagcagaaaaccgttgttcattatgccatattttttactgttaatttgaatttaattggttaggtagttacttttgtatttaatttataaatttgttttggctttgtctttttatcagggtaataaatgctaagttttgttttgtatgtattaaaataacatattaaaagtggtttaagttggcattaggagtgtaagaacacatttttcccttaaaagttgtatatctagtacttggtttgagaaacctcagtctatgatactgaacattattgtatcataatcatgatagctaaccttcaactagatgttttctatttcattttctatgggttgcttaaaattgtgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaatgaaaaatttcatgtttatattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctaggcagtaaactgtgacgattaccttgatgacaggattgcttattcagtgttctttttcattttctacctctggatcatgagtagcctaatttacgatgctaatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctttagttgaccctaaaacaaatgcgttttatctttatcaaatttttcatcatcaagctttaatatattgtgaaatcacaacatattctatcaagtatactatgactgaaattactggatgtattatttatttctgtctcccactgttacaattgtgtctataatgacttttatttccctggtttattttgtagcttagtcacaaatatttatgttcttatttatctttctgctcagagactgggacctgagctgtttccctgatggagtcaatcattttccagaaggatattccgacctattcaaatctaggtcctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgttagatagggaatagggttcactggtggactcaattttacccatttctaattgcttagcaagaggagtcacctgctgattttaatatgaagtttagtattgtgtaatggacaatatctttaacagatggtgtactgccagtgatgtagaacttcttaatcatgctccctttacaaaagaagaacactattagaaagcgatggtatgattttatacttgatcttcaacaagtgagaaattgataagtcaaatatacagtcagccatctggcattccacacatgttttcattgacttgggagatcatggagttatacaaagcaggagtagcacaatataagaaaatggcatgttatagaaatatttatttcttttattttagttatctatactattgatcagcaacaagtttatcagaaattttcattttattcagctatctgagtttagaaagaagtaattcagatggtatttacttttttttgcccaatcaaagctgctaggcattgaggaactgtttcagagtgggcatagttttttccttcacatgaggtcaaagccactaaccactgaattaaacatttgctgagcttggtttgcagcactttgattgatatagattccttcttgcaacttctttgagcctccgaaacttactgtgtcattatagaccccaactgcctttaaaagataggaatttcaacatcctacaatttagtcatcatttggatgaatgacttaaattattatatattttaggaatattaattttttatactacctgagctaagctgtgtgaaattattatcttatgacatacacactatttaatatattgaatttcagaaagttggttccaaatatcaaatagctgagtagaaagtagaaaaagacaatccagttgctgagaatggggcagaaaaaaaaaatgtgatttctaaatccaaagaaactagctccccttatctaatttatcctttcaaactaaaaatatgttaaatgctgtcagtgtgccgggtaagtaagtgctaagcactgacactccccctccttgtccttatggacctcaggctgatcctctttgttcccagcctggctcactgtcactctctccagcattcctgtcagtgtccacatggatggtcttttcaatattctggcttctcagcttcttatccttttcttctctggtgatcttatcctccatcctacatcagcttttcattcttacagccatactcttgtcattagcaataacagtggtctctgcataatctcagtttgaagcatcctcaactctgattagcattttgaatctcactgtagctcactgcttctagtacctccattccaacaatcttttgaccttattgattcttaaaagccacggattttaccaccttgttgctgtctttcatttccctgattacctttctttcttttacatccagtttaaatttcatgtcaatatttgcttggcaaaatctaattctagttaaatccatctctctgtgtaaatcctgagctgaatgtcactggagcaaaacatgccatgatgcaactggtctttaagttcaaggctgggaagttccggggcactcatgttgcctgccatcatgctgcatgttccgggtccattcggtcttccattctcccagatgactatttcatacttttttccccctcctcaaaacagcttctcccatccttattgttaggtaataatttagttttgcattttactgaaaggatagatgccactaataagaacttggataagctcttatcactgcatatatccatgtaccaccatcaatgcccatatgccttctttcctcctgcactctgaaagaatgtaagggttcctatcaacccctccacagtagatcccttcttctcttgtcaccttttcaaagacacggttccagttattattccttctctccattttattaattttctcaaaataatcagtgttctcttctctactgatcattcccatcagcctgcaaatatgctgttattttttccatcttaaaaacctgtcttgctgggtgcagtggctcacgcctgtaatcccagcactttgggaggctggggcgggtggatcacctgaggtcaggagtttgagacaagcctggccaacatggtgaaaccccatctctacgaaaaatacaaaaattagctgggcgtggtcgtgggcgcctgtaatcccagctactcgggaggctgaggaaggagaatcacttgaacccaggaggtagaggttgcagtgagtggagattgtgccactgcattccagccgggtgacagagcgagactacatctcaaaacaaaaaaacccaaaactctcttgaccccatattcccctctagtgactgctccctttctcttctcttctctctctctcttttttttttaagacagaatttcactctgttgcccagggtggagtgcagtggtgccatctcagctcactgcagccttgacctcctgggttcaaatgatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgttattaaatgctgtctttatgctgaagacttccaacttatatccaacagtctaattgatagctctacctgaatatctgagggcatctcaaagtaaacatctccaaacctgagctgctgatctctcacccaacatgcttcttcacagttttccctttctcagttactgggaactctgtccttcaggttacccaggccaaaagactttgaatcatccttagtattgctgtgactcatactgcacatccatttcatcagcaaatccttttagctctatctttagagtatatccagagtctcacaccatttctccaccttctctgctattatgcattgttatctcttactgggattattgcagtagcagataatcaatcttgctgtgtccacccttgctattgacaggctattcaccaaatacgagtcagaaggatcctgttgaaatgcagctcagagaatggcatgaccgtactcaagaacttcctgtttttctcactcacctgctctctgactcgctctcacagtaaaagagggtttacaatgtcctccagggccctgcttgatcatctacccattccatcctgtaactccttgactttatctcctactactctttcttttactctagaccaggcaatctggactccttgcccttcctctgatatattaaacattttcttaccccatggtttttgtacttgatggtcgctctgcccagaatatttattctctcagatatatgcatggtacacatcctcatttatttaaaccctttgcttaactgtcacctctcagtggggtcttcccaatgtccttaaaaatcatagtagtttccctccctccatcacctactcccctggttcatcatctaacaaactaaatatttccttcatttattttgtttttattgcatttcttgtgactagaatgtaaacattcatgaggaatgttttcgttttgtttgctgctgttaggaaagtgtctgtataatattaagtagtttaaaaacatttgttgaataaatgtatgaattattatagtcttttcagtgttataatttttctattacacataagaaatggagccttagagtgtttagtaatccgtggaggtaacacttaaacccaggtctttcttggctcatagtgcagtcactcatgtattttttcatctatcaggacacttacagggtactacaggaactttacattggatgaattgcattataagatagaggaagtcatcaatattgtgtgtcttatttgtgctcttctcctcaatcagtatctgggagaaaatagaaaccgatttttaacagttcatgttgaagcactttttgctacatcatagaaacttgtcagagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaattttagctgtcctgactcatagactggggagtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttacttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaagactagtacattaaaaaatcatctcccactatgtggtgattttgtccatttgtccttttagttgtgttgcttttttccatttatttggagcccattgttagataagtatagatttagaattatttatttcttgtgaattgaaccctttaacagtatgcgttttccctctttatctctggtatgtttttttcctgaaagtctactttgcctgctattaatatagtgacatcaactttcttttggttaggttttttattgtctattttttccttcttttttcttttttttaacaacctttctctgtctttagagtttgtgtttcctttcaaatagttgggttttcctttcttttaaattagtgtgacagtttttattttcattgaaacattagattacttacaattaatacaattattaattggatttaaataattcaccttactatttttttttaatagagacaggttttcactatgttggccaggttggtgttgaactcctggtctcaagtaatcctcttgccttggcctcccaaactgctaggattacaggtgtgagccaccgtggctagccatactctttattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagcatatatttaaagatctaatagaatagtttaagcagatagattgggattgggtgaagtggctcacatctgcaatcccagcactttgggaggccagggtgggaggatcacttgaggccaagagttcaacaccatcctgggcaacataatgataatgagaacccatatctacaaaaactacaaaaattagcccagtgtggtggcacatacctgtcatcccagttactctggtggctgaggcaggaggataacttaaaccaggagtccaaggctacaatgaactgtgatcgcagcactgcactccctgggtgacagaatgagaccctttctcaaaaagaaaagaagagagaaagaaagaaagagcgagagagaggggagagggaagaagggagaggggagagaggagaggagagaggaagggaaagacaagaccctgtctcaaaaagaaagaagggaagggagggagggagggaaggaagaaaaggaagagagggagggagggagggagggagggagtgatgggatcctgtctcaagaaagaaaggaaaggagggagggaaaagctcattgtgctatgggaaaggaaggaaggaagggagggagggaggaaggaaggaagggaaagactcattgtgccatgggaaaggaaggaagaaaggaaggaaggagggagggagggagggagggacgagaccctgtcttaagaaagaaaggaagggagggaaagacttattgtgctatgggaaagaaaggcaggcaggcaggaaggaaggaaggaagagggggagggaggcagggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagttctttttgaaggaggactggttttataaactctggcattgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcctttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgccttctcttttcctccttcattttctttcttcctcttcctttttcctttttttttcagctgaaatgaaaatatacttaaagtacaaaaggctaatatgaagaaagcagatgaagggaacttaaaaagtaggaacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacattagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggactatccacacttttgtttttgctttgctatataactggacactatggtgcctggactgtaaaactcagtggactaatttttcacttatgaaatgaagaccatattttttttcatgggaaaagaagattttgacatgttaaaactggagaagagagttgcatgtactttgaaagtagaaacagattattagtagaagagatttcttcatagataaacacaggtagatattaacaatattacagttttttgctttgatgaatgatctttgcatattctttttattttttttatataggcaagtttagcttcttaagagtagtatcttagttaacagaacatggtagacatctgataaatatctgttgaataagaggcatttttatttttatataatatgtaaacttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcctctttttagctcaaaatcctgattttataaacatacatctgtgactgctaatttcttcactgtaatggaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcactgttcatttctattacaataatatcttacaactgtacaatattagaacattactactaaataatgaacattgtcattacatcatacgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatatcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttcaaggattctaactctgaatcccttcttgactcccaggggctcaatagaggtcacagtgatattggctctttcatagctagaaagcttctctgcagaagaaattaggataggaaaaaagggctaaccaccaaagtcttcatattagtcttctctagatggttgtctaagttgttctctgggccagcagaataatcatcactgctagcttattagaaatgaaaattgtcagtttttatccaagacttgcagcattagaacctctgggagcagagcccagctctctttgtgttagtagccctatagattattctgatccatgctcaagtttgcgaaacactgcctgaggtcagttctgaaacaatagctgatgttgcctgtgtccatttatcttattttattcttagttcttatatagagaggatgcttttgacctatggttttcttagatttgacctctggttcagtatcactatgactatattttggtttctacttttcctttttttttttttttggatcttctgaccctgattctgtaattttctagccctgtgtctcagatgtactttacactggtggtgtaaactccaaacatacagttgtttggaatgatataaaaggaatggtgcattgtgattcagcatttgattgaggaggcctctggaagacattctgtattgaaggaatcaaagagacagttaaaagaaggtgctttacattcatttcaaagaccagagcagcctgacaatttctaagtggtagtatacttgcagtatccataagtaaaaatttaatagattgactttttcccctacatcccttctttttaaatttcttgtgtacatttgggaatagttaaaattgaatggatgaaaacacaaaattgtacatttaaagttttttagaagagttcatattgggactcataatggttcatggatggactaataaatatggatgtagaattattataaatactggctgacatttatataaaaataattgggagttaattgggagctacatttttacataatggtccattaggttaattatgcagtactatcgttcctcagtatactcaggggatttgttccagcccctctaccccaataccaaaatccagagcatactcaagtcccatggctggcctgtggaacgtgcatgtacaaaaagttggccctccatatatgtgcctttcataggccatgaatggtatattttccacccacatttagttgaaaaaaatttgcgtataagtggacccctccagttcaaactgtgttgttcaaaggttaactgtaatcttaaccaaatggaacatagtcaagtataagtaaggatacaaaaagaggtaagtgaatgccaaagctgggctttttccctaaagttatcttccaggtcctggacacattgatcttctgctttgatgattctatagggcactgaggatgggagataaagtacagagctcactttaggtagagactttgctaggagcccttgattaaagcctgtgggaccacatctgcagtgtgaggtgcaaactttggaatagtctaaggtaatatttacaaaatctatgcatttaagaccttgtattttatttatggaatggtatcttaaacacataaatacatttatgaattatgtaattccataaagttagatatgttaagttatgctaatataaggcctcaagtaatatggaaatttatttatctctaatataaatgtctaagttggcagtccagggctagtgtgatagttcctcagtcatcaaggtaccgggcctcttctctctggttactgtgctgtcttcaacatgtagttttcagttcctggtcctaggtagctgcaccagctcccaatgccacatatgtatttcagctaccaggaagggaggaggaggaaaggaaggtattctccttctctttaaagaataacttgaagattgcacacattaaatttcgcttcccacgggtcacatctaatcatatggccatgaccacacctaaccacagaagaggctgagaaagctagtctttggcttaagtgcctaactaaaaatgttattattacacaatgacaggaaatggatattgagggacaactaccagtctctaccacaattacttgcatggtttccaaaagaagctataaattttaaggagggaagagatctgtttgaaataattcagctgtttaccctttgactcatagtccacttctaggaatccattttggagatacattggcaaaaatttgaagaaaatgttactggtcattgcagtgccctttaaacgaacaagaactggaaacaacacatttgcccatcactagaggattttaggttagttgaataagctaagctccatccatctgatgggttacactgcattgtttaaaggaaggagacagatctctttatattgtggtaatagtcagggtttgattggagaccaaaactagaagaagcaaaactgaaagatataagaaatatattctaagcatctgaccatttgcagctgtaaaaactagttaaacagtttaagaaagattgttgcttctgtgtttgatgctataacctgaagtccacggggaagactgtgaggaaaggaagatggaaataaagtaggggggaacaagaacaaaatagaacttgctacagtggattggaacttaggtccatctctcaccacctccaaggcttagtgtaggaaaaacgttggctgctaggagaccgggtaggcggctgtttgaatagcctgtttatatgatatcatggagaaggcctggattagcagaaggaaatgggttagaaatttttttagattatatgaaatatttggtgtctaaatgaatttaaggaggggaaaggagaaggaggtgttaagagtaagtgtagaataagattttcttttctggtattaatggaggaatagtagattagataacctgaaataaatggtgtgtgattgtgtgtgtgctgattttaaatatatactgagctggcatgaaaattagaacgctgcagagttcaaaagcaaagtggagctcagaattctgggaggtaagtgaatgccaaagctggctttttccttatagtcatcttccaggtcctggacacatttaacttttctttgatgattccatgggggcactgaggacaggagataaagtacagagctcactttaggtagagactttgctaggagcccttgattaaagcctgtgggacccattcacagtgtgaggtgcaaaggtggcaggatggaaacttacctgtcttgctctatcctcttggagaagaaaaaaaaaatctcttctgagagtttttatcacaagatgaaccttacacaggattacaatttgagtatgtgctagtagtgcggtctgaaagcacttaagcagataattaaaagtgattctgtgtggatggtgtccatgaaaactgttggaaggaaacaaaatcctctctggagtcacttcaacttaggttagcaacaacccagatactcccacagataaagctccgagtaaaagatagaatccctttgagcggaaacaagaaaaggaagctataaacccatgtagactttaaatattaaaactattttataagaaatgcaaaatgaaggccacgtgtggtagctcatgcctgtgatcctagcactttgggaggctgaggtgggaggatcgcttgagcccaggagtttgagaccagcctgggcaatatggtaaaaccctgtctctacacaaaaaatgcaaaatgtagccaggtgtcatggcatgcgcctgtggtcctagctacttggaaagctgaggtgggaggatcacctgcgcctggggaggctgaggctgcagtgagccatggtggcaccactgcattctagcctggatgacagtgagaccttgtctcaaaaaaaaaaaaaaaaaaaaaaaaaaaaaagcaaaacatgggtttcatattaaaaaaaaggagacacttgagaatacaagaaggtgacaagcaaagttgaagaaaaacaacagaaggtttaaaaagaaaaatataataaaaatctccaatggtttaagcccagaaatttataaacagataacgggggaattgataaactggaagataaaaccaaagcaataaccagaatataatctagagagataaagagaaaggaaagagaggttgaatgtagagggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttaggaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgtcattattgccattttatagatgaggaacctaaggattagggaaattagacaacttgcccaaagtcacacaaccaggattgggcatgtttggcacagatggtgacttttaagaaacttgctcaagctcacagaaataatgagcgatggatttaagttttaaaccaagacattttgacaccagaggctgccgtctttctaatactaccctattttgcatcccacctaattattattgaatggaggacataaatgaaatataacttcctccagtgtcctagtttcatgtcaggaaatagctgtctagtttttaaaagtttcccacataattaaaatgatcttattttttattttttcgagacagggtctccctctgttacccaggatggagtgcagttgtgtgatcacagctcatggcatcctcaagctcctgggctcaggtgattctcccatctcagcctttgaagcagctgggaccacaggcatgtgccaccatgccttgctaattttcgtatttctcaatttttttgagtttttgagaaactcaatttttgagtttctccatgttgcccaggctgataaaatgatctactttttaactgaatggaaatatatacagttggcgctttttatctgtgggttccagagccataagtttaaccaaccatagattgaaaatatttgaaaaaataattacactgaacatgtacaggccttttttcttgtcattattctctaaacaatacagtatagcagccatttacatagaatttacattgtattaggcattataagtaatctagatatgattttaaggataagggaggttgtgcataggttctatgcaaatcctgtgccatttagatcagggttctgagcagctatggatttttgtatcttcaagaagtcctgaaccaaacccccatgcataccaagggatgactgcactattcatagccatgacttaaggtagtacatccctatgtagtatatagtccaaggtttgaatatatatatattgcattaatttctccattggcataggattaatttgcttctttgaaagttataaaaactacatgtcacagtctggtctggttacaggtagggggtttgggaacctttgcaccttgtaatcattagtcattaagggacctagtcatatgtccccagatagaggcaaaggcagctgggaaatgtagtcttcctgcatttgggcaagaagagatgaggtcgtttggcccctgtgcagcattgtgccagtcacagttcctgttgatctctctgactccatcatttctgggcctgatctctctgactccatcatttctgggcctgtgctcataaactgctctctgtgcaaacctctgggctgtggtgactctcccacatgtccagcctttagaaatgatttctttcaattcaaccattaactttataaatcgtacagatgaaaataagtcatatattctttatgcagcaattttcttgaattttatttctccttattttgaatatgcaatcaatatatataaaactttaggtttcctgaacatagaaggagaaagtaacctaataatattttcgatttcctgattatttattgtaattatgacatttgagtgcaatgaatctttttagaaatggagaaggatgtttagaaaaggtagataaggcagaaaaatccagctggtgtaaaaaatgtacaaaatagtgatgattcaaaaagagtgagtcagtgtgacattatcacatataggcatcttgtgaagaagatattctttaatgtcttttggttttacttaattgaatgacacatgacatcagtgatattgaattaaatatgattttcatctgtgattcttctagtgggaaatcaagacagactaaaagactaaaatccttgtattgtttgtcttgtttctaggatttctggataatccaaaaatacgtaaaaataggacataatgatattgaggaacttttttagcagatgtactaattgtgtatgaattcatatattttgaagagacgaacattatttaaagtagctttttaatggtagaagacttaaaatattttttgccaagtatcagtgtacgtaaagagagaaattaatattttgtattttacattaagcagattaatttgtgcgggttagtatatttaatgctaggtacactcacaagagtaagttggatccattagtgggagaaattgaattcatttgttagatttttaaattagtttctaaattgaaataatacacataatttaaaaagtcaaatgatagcttctaataaaaaatagcagttccttaccttacccttcaccaaatccaagcatctttccccacaggcaacaactttcaactcttttagttgaaagagttgaactccagactttaagaaatgcattttatttataaatcatccagtcttaggtattctgtcctagcaaaacgaagtggactaagacaattaggtttgctaaatgtcagctggatccttaactacagtgaggtagttctgataccctcttgagtttatttaatttcttctttttaaattaaaaatgtatacaactgctgaaaatcagataattttattttgttgtacacaatattataattaaggcattggtttacaatggcttaccttattttcttaaaaatatttatttttctcattataaaggtaacacatactctgactgtcagccatcgatgcttaacaggccactcctgaaactcagtggctaagtcaacaatgttctttatatagctcatctgcaggtcagcatttaggccggtcacagctcagcaattctggtcttgtctaggcttcctcataggtctatagtcagttgtaggtcaggtgtgggttggatttgctgattttagttgggctatttcaccagttgtggctgataggctttggtctatctgtccctttatcaccctgcgggctggctcaagcttgttcacctggtggaagcagaggttgtaaggcccttgaagcataggcttggagttgacatactgtcacttctgccatagtatgttggccaaaataagtcacaaagtcagcccaagttgaagaggaggacaaatagacaccatctcttcatgggaaaagatgcctactcatattgcagaagggtgtgaatacagggagatttggattctgtctattgcttaatcttttatatatgtttgtactgaaaagtacaaacaaagataaaaggaactcataagtccatcctctaactactgttgactttttgttttatatactgtaagactgttttatctatacttttaaacgtatattattaatttatttcagtttccatttgattacaagtcatgtttgtttatttcatatttcttctatgaagtggtcaagtagatttctattttgttcttaaaatcgcatggtagcatttcttgtaaatctacagttccagatatctaaagccggcaggacttcagctaataggcaattattctattttgtgatgagaaggccctgacttagtattgagtagcaggaagaatcaaaaggtgttcagtcaactgacagtgcaattgcctttgaatttgtttgtatatcttctgtgactgagttaataaactgaactattcatggaataggacccagtgggattttcttatgctatggtatatttttaatattattcacttttcaggctaagtttgaccgtaagcagatatctatttttgatcattagctttaaggtatttacattctcaatgactaagcttaagctatgtggtagagtgatttatttttgttcctgaataaaattttaataccatgagtcatgtgttttctttgtaaaaagttccagcatcacagaactatatagcataatatagtgaaagttcccttttcctactggctcactttgaactcctttccttaagcctttttctgtgcttttatatttacatacatatgtgaatatatagaatacatttacttccatgtaaacagattttgtatgtgtaacataaaaatattgtattataaacattgttttgtaacttgctttgcaaattattttctatccatttagtcaagtatgtgagtgtataaaatgtacacacacaaataatacaaataagagcatgttacaaatattgtataacttgctttttttaccaatatatttttgatatatttctgtatctattcacataggcttagctggtttttatattcataaaaccgtattcattttatagtcataaaatttcttcacatgtaccttcacatgtatcctttccctattatggaacaacgaattgtttctaaattctggttattttaaaaaatgttgaagaaaacatctctgcttgtatatatatgtgtatgtagaagaagaaaattacgcttgtgttctttattgtaaatattctacaacctgtatctcttaatccctttcttgctttctctaagccccatatattcaatttagccctgagtaatgcatgattgacgaagccagatgctgtgtgtctaaacagcagttaatgaaaaactatggaaggatagggaatcattaccacaggtactgtggggcggcaagactcaataaagtaactgttactaaaatctaaaaatgaaaacaggaaatatttgtcagacatttaacttggcaattgtaagagtgaaaaccttgtgtttttattcacttgtgtatcagaatttgccgttttttaattaagagttattttttaagagcaattttagattcacagcaaaattgagagatagacatggagattttccacatacccactgacctcaaacaagcatagccttccccattgccaacatccccatcagagttgtacattttttacaattgatgacctatgttaacacattgtcatcactcaaagtccatggtttacatcagtgttcactcttagtgttgtaccttctgtgggttgtatgatgacatgtatctaccactataatatcttgcagagtatttccactgtcctagaaattttctgtgcttcatctgtttgtctcccctcacttcaacccctggcaaacactgatagctttattgtatccatagttttatcttttccagaatgtcatataattggaattatgcagtatgaaaccttttcagattggcttccttcacttagtactatgtatttaagattcctccatgtcttttcatggcttgataactcatttctatttaatgctgaataatactccattgtttggaagtaacacagtttatttattcattcacctgcagaaaggtatcttggttgcttctaagttttgacagttatgaataaagttgctgtaaacatccatgtgcaggttttggtgtgcaaataagtttcaacttattcatctggtagtaattgttttataaatttgggagctccagtgttagatgcatattatttaggattgtgatattttcctgttggagtagtccttttatcattatgtaatatccccctttgactttttaaattgttgttgctttaaagtctgttttgtctgagaatacctactcctgctagctttggtttccatttgcatgaaatatctttctccatccctttaccttaagtttatgtgagtccttaggtgttaagtgagtctcttgaagacagacagtagatacttggttggtagatttttatttattctgtatctcttaagtggagcgtttaagccatatacatttaacattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttatttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaactttcagatttttcttcttcctcaggaacaccaattattcttaggtttggtcgtttaacataatcccaaatttcttggaggctttgttcatttttctttgtctttcggttaatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgaatctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatgtctgcaaagagtcctgtgaggtgatatgtcttcatatctcctagctgtggatgccagcacctgctccagtataggtggcaagggagttaagtgtactctatgatagtccttggttgtcgttttgtttagtgtgctggttttttcgaatgctggttatgccagcagtgaagttgttatgtggacagacttagaacctctggttagtcaggatgttgtagatggtagaattagctgttttctccttttttggagcagggttattctgttatgtcttgagttggttggcctctacccaggaggtggtgcttttaaaagagtgccagctgtggtagtagaagggggatacaagtttgttctttgttggccaggatgagtacttgggttcttcaggcaatggatggggctttagagttctcaagggtttatgtattttggctcaggctaccagggtgggtagtgaaaaaccatgaggtgggggcaggcctaggcaggtctgagctcagactctccttgagcagggcttgccgaggccactgtgggtgatgttccggggcattacagctgcctctgctgtgtcatactggtcgccagggaaggggggaaagccggcagtgacaggcctcacctagcttccacgcagccagcaaggccaatctcactcctgccatgccccaccaacagcacacgtttatattcaggcagctggggagagcggatagatcttgccccagactacaagccttcctgctgagaaaacaagcagggctctcaggccttgcccttttccgtctgcctgcaccatcagctgtggcttctgtgcttgtatctgcaagttatatgtgcacttcccatttgccccctggactctgctcaggaaaatttgtactcagttgaacgtattatgaagttcagctagaagcttctttcatcctatggcccctccctaattccactggctgccttccccaaggacccctgtgagataagtcagggatggctttctctggtttgagccgggaactgggagtgcctacagggcgcttcccgctccttcttctactttgatatttcacttggctgcctaaatccattttaacttcagatgagattaaattcttctcctgtgatctggatttttaggttccccagtggggatgtctgttcagaggcagacttttcccccactcacactttgggaacttacagtttttcagctgtctcatggagtttgcagtgtcaagctacttctttcaaagtaagtagcctgtgaattcttttggttttcctggtaggttcctgtggtggttcttggaggaaaagtttacagtgtgagtctccacacactgttctgtctgtccaaatgggagctacatgttagtcctgtcttgtatctaccattttctccatgttggtaatttagatctttgtatttcctctagcttttaaaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacacatgcacgtttatgttcactgcagcactattcacaatagcaaagacgtaaaatcaacctaaatgcccatcaatgatagactgggtaaagaaaatgtagtatatatacaccatggaaaactctacaggcataaaaaagaatgagatatgtcctttgcaggacatatctggaggccattatccatagcaaaacattatccactatagctggaggccattatccttagcaaactaacacatgaacacaaaaccaaataccacatgttctcacttataagtggaaggtaaacattgagtacacacagaaaagagaacaacagacactggggatctacctgagggtggagggtggaaggagggtgaggatcagaataatacctatcactgaggttggtggatcgcttgagccaagggtttgagaccagcctgggcaacatggtgagacccccgtctctacaaaaaaaatacaaaatttagccaggtgtggtggtgtactcccatagtgccagattcttgcgaggttgagatgggaagatcactcgagcctgggaggtggaggttgcaagtgagccgagattgcaccactgcactccagcctgggcgatagggtgacaccctgtcttaaaaaaccctccaaaaccccaaaacccaaaaaacaaactaccaatcgcttactatgcttattacctgggtgatgaaataatttgtataccaagcccccctgacatgcaatttacctatatggcaaacctgcacatgtacccttgaacataaaataaaaataaaaataaaaaaaggttttctgaaaagagaggaattgtttttgcagtttagtagccattgatggggtggttcagatttagcaagagaggtggatagaaacagttgctgggtctgtggtcatatgagggccactgtggtacatttttagtctttctgagactcttacagattatttagaattatttacaacatattctaacatatttgggagtgtattttatcattttaaatcaagccataatcttccactttttgactacaggccattcctaatgtgtttctcagaatgtgtgcaaagtcaaatatctggaagtcaaatatttacttacatttaataaatagatttctttaccaagagagctaaaataaaattctatttaaacttcaccttttatacacggttgtcagtaatatagtttccaacattttatatatacctttaatttttttctttttgaattgatcagttcaagtgacttaaatgcactgagcatccagctgaggttaaaaatttactgtgtgcaacatagcaaataatttctcacttgacccttacttattctctttggtgataagagtgttttcacttttctgttttttacttataaagtattaagggcaaataagaattctaataatatagaaacattgctatacaggcagtgacattaacaatgcccaaactgaacacttgactagcagaaagggtgttgagcttccattcttacagctagcttatcttcagaatttcaaatttagaataaaaggcatataataagccctttaggagttttcatctacactatatatataactgtgtgttgagcataagttgaaaatatgaaaatttaggtctgcccatacttagaggcagataggtagaaaacactaaactcttaaggccattaggtatttagtaatttttatgtacagttactttttaaagctagaaataaagttgtaggcttataaaaattacagttgagaaaattttctcagtaatatatattttagaacatttattaattttattaataccctttcagcatctctcagtgttgaacttgaatttatgaattctagctaatttatatatctttagcactgaatatagctagggtatgaagtgattaatattggactacaaataatagtttctggctatgtaaataaacttggagttcttcattttttgtagtattaatgcatgatttaatatgaaggaatttatgttcaagaaaaatacagatttctaatggaggagtgatatatagtaatgcactgaggcagatggtggatgataagtatgtatagatcacacctgctttatggaatgtaaagcttgattcgtgtgtaaaaaattaatttgagaaaatggtagggaatggctgggagtctgtgagagaattctagatttaacactttgattagtctcaggaaaaacagccattatataatcttaggttatattttctatttttaaacaaatatggcaagcataacacctccctttttaaaatacacagtttttgcaatttttcaagacttagggaaaggatcaagcttgatatatgtttatatttaatacttctgaaacccattttgggcagatttctatctactataacagtggttatgagcttggaccgctgagtggccacactatctataaccgagttctttaatatgtctttgcctgttttctcatctgtagcattgggataaatctagtagcagtcacattgagttgtaaggataaaaggtgatactttaaaggtgcttaaacgtgcctaatatgttgaaagggctcactaaatattagcttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgaccgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttagatatgcaataaggaattttgcagtctaataaatatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttccccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaattactgagctagcttgagagcttagcatcaatctttcaattttttaatgaattcatttaaaaaagtgctgcatcactgatgtgcttggtgacacagaaaatgagattctctggagaaatgtggacactgatatatgtcaaagagtgagggagaagaattacatttggatttcttcatgaattttaggaattgattaaaccaacttattttgcttatgttttgtttttatgtctgtgtcagtgtgatagataataaaaacccatatctaattaagtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgtgagacttaccagttaattaattattgaagaaaaaaattagactgcatttgagtttaagtgggtccaagactttctgtttcaagttaatattgctgttcatttaaaaataacaggtgatttttttttaattttcagtgttactcagtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggagaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaagataaggaggtcataaatagaataccaaatgtggttttgcttcttttacagttagagagctttgttaatatcctcattttcttcatttgtactagcatttccaaacagaatttgtttcacaaggaagtatcaatgtatagtgtctctgtcaggccttgcattaagcccagtttctcatagtcggttttcaatgacatttctaatttggtatactttctgttatatcacaacttattttcccagccatctaagggagacttgttaaggtgggtcaacctcatttttgtttttgattttaatattaaaaattttgttaaaatttttatttcgaaatagttcaaacaaaaagattgcaaaaatagtatgaagaattcatatgtacctttcactcagcattcccccatgttaacctcatacataaccacggtaatattgatcaataccaggacattagcatggatacaatactattaactgctctgttcacttaattccaatttcgttaattgccccactaatgtcctttctttggactgagattctatccagagtctatttatcgttctttctccttagtttcctttattctggggaagacagttcctttgtcttttttgtctgtcatggtcgccacatttggtcagctcttttgtagactgctcctcaaattggatttgtctgatgtttcctcatgattaaactcaagttatgtctttttggcaagaatattatagaagtgatacaagtgacagagtgtccatttcagtgcatcatatgagatgatgtttacttgtttttactcttctgttatgaatatgtaccccactgctaagaatgccagcttttagcctttgtgcagctaattatatttatttttcaagatttgcctttttaaaatggttttctttatttgctgcacttcatttgatctctcacttctttgccttccttttgccataatactcagtaaaaccttgtcatgcttatggcttgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttagtctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttgattatcagttttatacagaaaataatagtgaaaagaataactctttttttagccttaatgactctgtcattgaattacttcaaattgtgatgatattttcttcctaagagctgattaatttaatgtgttcacactttgttccaataatggtcctaagattacaggtggaatactgggacacaaaaataacacaatattttgtcagagatgaccaaactcattagatacagagacaaagccagaattgggtttctggttgggtagatttacgcccctcctacctttccccattagactgaattttaacaaaccagacaggctttctcaggtatggagacttcaaatatgctgctgtaatcagacagcatgagctaacatattttaggaatatacttgacttcattttaaatagagaacatttatgttttctcactatttcatgtgtaatgcaatatgaataaagccctatccgagtttcatgtttgtggggaaactagcattactgcagattagtgacagggcagagaaatgaccttattatctctgtaatggtaatagtgtgcttcacagggaaacttgtgttgttaagagtgagttgttattttgttgcagatgctttctgcacaagttattaatatattgaatcagaaggattggaaagtgctatctagggacttaggaatataatttataagtttcagtattcacctttacttgaaatatgtaaatctgattttgtagatgtatacacaagcataaacatggtttcacgcttgtgtataccttttctttctttatggaatatactctctatttttcttgtgtcaagtacctctgtctctaagacccacagcagttgtatcctccgtgatgaaacctatccctgtaaccgagttgttgcttccctttagattcccagagcaatttgttcccattgctatattatgattttatttgttggcttataaatctatttccatctttgtaactcacagttgagcgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaattattgtctattttgggatttatctaaaaaagtagttttatagattttactgttttttatttaaacatattaatcatttaaatgatattaagctctcactgacactgattatataaatgtcattggattggaaatctacaaaaaaacaaggaataaaattcaccactctatcacccataaagcacccattacatttaatagtttttacttataaacatgattttaaaaactactttgacatggaaatatggtcaagtatattgatgagtgaaaaaaatgcagattgtagaagagttctgaacagtgtgtacaatgtgattctatttgtgaaaagaaaaaatattatatatgcgtacactaacatacggtaaatatctgaatagatatggaatcagttcttagttttcaagcaaatgaaatcaactctccaatataagcggaagaaatttattgaaggataataaattactcacagatttctggagtccttgagaatcaggtttagaggccatatatctagaagcaataccccaaataactggttctgcaaagaggccctggcaactgtcagtctgaatccttgatactactaagcctagatgccggatttgcctccactgttagcagtattccagaatgaattctagacagttactgctcttctgtgtcatcagcttccaattcagagtctgctgtgggtgcattggattgccagagcccaagttttgtgccctggctgcagaggaaccttagcggggaagaatgtggaactcacttctgtagtggacaaagggccctgcctcctaaggtaggggatttaccaaatgtaggaagaggattcagaatcttggatgccagaaagagtgagagccgtccacagcagactcctgggaaattgttaacattggttacttctggacggtggagttggaagggctaactgggagccttccagagggaggcttttactttaattttattcttctgtcctttttgaatatacatatataataaaaaagtccatggggaaaatgaacaaaagggaacaacagttttttccagcatttccactgatagtattttcgcataagaactcaagaatggctaggcgcgatggctcacgcctgtaatcccagcactttgggagcctcggggggcagatcacctgaggttaggagttcaagatcagcctggacaacatgttgaaaccctgtttctattaaaattacaaaaattagcagagcgtggtggtgcgtgcctgtaatcccagctacttgagagtctgaaaatcacttgaacccaggaggcagaggttgcagtgagctataagattgtgccactccactccagcctgggcgacagagtgagactctgtctcaaaaaaaaaaaaaaaaaaaaaaaaaaggccgggcacatgcctgtaatcccagcattttgggaggccaaggtgggtggatcatttgaggtcaggagttcaagaccagcctggccaacatggtgaaaccccatctctactaaaaatacaaaatttagcctggcagtagtggtgtgcacctgtaatcccagctacttgggaggctgaggcaggagaatcacttgagcctgggaggcagaggttgcagatcacaccactgcactccagcctgggtgacagagtgagaccctgtctcaaaaaaaaaaaaaaaaaaaaaaaaaagaactaaagaaggcttctcagcataactgggcagttttatcaacttcgtactcaattttattttgaaattcagtttataattttctcccagattcagtcatctctatataacttggttgggcagagaagttcataaaatggttttctctcagataccagtggcttccttttggcttggtagagctgatttagtttatctttttgaggtctacagtattcagctttgaaaagtaaggtgttgtcagtgactctgattgatgaagtgttcatagatctaaggtgaaaaaatacaatctactttaaaatttttggccctactattttttccaaacccccataaatttgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtgaaggtgaggtgtctatatatattaaaatgtatatgcatgtggtggccataaatatattacaacaatgtattaattagaaacacatatcttttggaatacatgtatacccatgttactttcgctgcaaatggctataatctttttcatcacatttcctgccatctctcatcattactttgctgctcacgtggacccatccactggtcaagcctcaaaattccatatcttcctttttttccagtgaccctctctgctgatccacttcattttccccccgacttgctgtcactttgctctacctcccaactttttctctggccacgaactcctatctcttctacttttctctctccttcttttacagatatggtcagttttaatttttctgtataaaggaaatccttattttaggaaatttagggcaatgcaatataaagaagataacaaaaatagttttcaatatcacaagctcctactctcctttccttttgatttttggcatggagagctagagtccttatggtttctcaccttcagtggggtaactctgctgcttggcgagttgtatcccattgatattgtccttggtgggtgtggcaaacctttttgctatccttctgtccactttttgatccacatctctgtggtcagctcatgaccttacttctctttttaatagggaggttagagtgtattaggtattaattcagataacttgctcttcctcttgcttctaattctttccttcttccctttgtcttgaagaagaggtgtctggtttacttagcaacctctgcaaatcagtttcagactgcgttccattttaccttctccaggactgtagtctattagctagtccatctctctcctgcatcttcagttttccatttcttgttgctcttatttaaaaagtatgtttctcttcactatttaaagattcctttctccttaaatacgattatgtctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactctgtatatagtcttaatactgtggattacagtctaagggttatgtggagattctggctcctctaatttacagtttctatctaagtagcctcatgacctttggcctgattacattggtcttgtttttactattaagatttacatagccagttccctcttaagaatatagtttagctctcatttacctctttatatccagtatctttcacaccaatgccaagataatttaagaagcatctattttcatattgatacaaagaaggttaagcactctgtttgtaatagtcttatcaattaagtctagctacatgtaaattatatgtacctagtcttaatagataagtacaatagatatatgtacgattaatagatagatgtacaattacatgtaaaattgtaggaaacaatgacatgtattattttttcttgatatactgctatagtatagggcattttatatttaccacttttaagagctttggcattttcatagcttttacaggctctttcttgggttagttacatgaaaataacctgcagatactactgtaaaagtatagcctaggatgtttttaggtgaagagtgttttataatttagtagaagatgtaagatttgttatagtaaatgtttgtgaagactcacttgacaccatctaaacacttgacatgcttacaaatgatcccgagccattctatttgtagttgctgtaattaagagcaatatttcagattgagttattcatagcttcatgaaaataacgctttttgcaggcattttcaaatcaagtcagacaccgggttttctttcaaatagccagacgttccaaattatagttaaactagagttgtcttcttgtttgcaacatatatccaccacttatcctggggtttgtatttttagtgtagatggtgcttttgtatggggatatgatgttttatgatggcgcagtgcggagggcattcacatatggtcagggcaagcacttttagaactttatttacgtatctatctatatatatataaataataccttaaacattcaaaaagcatttgtagcagcttattgtaaagcacaagtatactaatacttcattttggcaaccgtggaagcaaagagagtagagttaggggcagaaagaagggtgaagttgtttatatttacatcgatagcagtttgcttttgcatcactgtgttaaatctgttggtcgcatctttgtctgatcctagaatgcagatccattttccttagggctctatcctactgggaaagatgaaagaggagacaagcgatctctactgaatgagaaagtgatgcatcagacctctgacttattagcgtcattattttgttttgttttgggatgctttcatccggttgtgacagtgaaagccagcttcttgattgctttgggtctatttgagactctcttcgttgctgatgatggtacctctcctgttttcttttgatgtatcaaaagaggtaaaattttgatacttagctttttcctgctaggatttagagatgattttaaagaagagggccctataaccaaatatttatatggaaaatgagggttttttttcccccagagtgaagcttttttaattcatcttgatgaattctatagtaaccaaaatttatattataatctcttttaattagctgtgttttatcagttgtttttgtcttatgactcattagatcgctgagttttattcgttgtgtgtcaactaaaccccaatatatatcttttggaacgcctgatcaagaaaagaaagcatattaaaggcaaaaacgattcgttgaacacacattatcatactctatacactaaaatgcctctgggacacttgaggaattcatacttcttgcttaatccttgatacatggtttggaagttataaaccaaaataaatatttgctcggggatagagaaaggagcagagtctttgactgttgctcaagggagttaaaaaattagagacttaaatggtcctagaaaccacagctagtttttccactcaattctgaacttgatattaaaaagctaagctggagacttctgaaaagcacagtagaaaattcttgagttttgaagtgcttaagagacagagacctaccctgtgccatgggtgtgtgtgtgtgtgtgtgtgtgtgtgtgtgtgtgtgtgtgtgtaggtggattggcttaagagaatcagctgtgtgagttcaaagccctgaaatgagtggcatgttgacaccgatgacctatagctgctttttagttggctacacttgctatttggtctcaaccaggtgtgtagaatccaggtatatagaactcatattttgtggggctgtagtgacaaaattgaaattttgaggggatttaaacacatacttgaccttttatttgccaaattctaaaggtgtgaatggtgaaaggtaagtagaaaatatctggaaagtgaagctatcacttggtaatgaagtgacaaagacccatcatactctcaattgaaagccatggagagttaggtcttacaattagaggcaaaccagatgtagaccaggtcatctcaaacccacaatacagcctctacccctttgaattttttattgaattatgtacttttactctatctgcgcagcagagccaaggagtcaatcctctcattatctggaacttctataaaccagcattcaataaaaaactaagtagatgaagagacaggagtatttgatcaataacaaaggggaaagaaacaataaaaagcagaagcacagctgatccagatattggagttagcagacaagaacatcttgattgttatgcttaggaacatagagaaaataaggaacaaaagaggtaagagggtggagaattaccctagaaagtttgtgtgtgtgtgtgtgtgtgtgtgtgtacatgtatgtatatggatcaagtaaactttgtggagccatcagagaaatatatatctgacaataagaactcaatgaataggcttataacatatcggactcagtagatgatagcaataatgaactggaaggctagttaatagaaaatgtccaaattgaagcacaagtcagaaaagaggataaaacacatttgggatctggtcaaaagatctgtcttatatacaatttgaattccagaaaaagaagagagagaaaatctctaacagtatctaaaaaaaaattctcatgaagatttcagaacatcattacacaagctttgttaacttttaagattatattcaaagaaaaccacacctgtatgcacaatggcataacatcttaaattgctgactgtgctagcctacaattctatattcagtgaaaatatcttttaaaaattaagatgaaataaaaatagtttaggcaaacagatattgagagaatttatcactagcaggctctcactaaaagaaggtactgcaagggagctccctttggcagaaggaaaatgattctaaaagaaaatatggaggagagcatacactatagcttagtattgattatccgaaacagtagtcataattttctgtgaaagtttaagtttagtgaagtttaagttaaatatatggaattgaaatgtaagacaataaaaacacaaaagctagggggtcttacatggagttaaaatattctgttgttctaggattattatgaagtgtaatgttctggttaggttataatcaaggatacaagttataatctccagtgtaacaactgaaataacagggaatgaatgcatatctagcaagttaataagagaactataaattaataaaaatatttggttaatccaaaataaataagtatgaaaaatggatgggtcaatagataacagatgataagatgatataaacccaaatatagaagtaattaaattaaatacaaaaagattaaataaacctagtaaaagtctaagatcctcagacttcatgaaaaacaactaccaccaccatgtgtagcttaaaaaaggcatactttaaatataaggacatcaaaatgttgaaaatgaaaggatggaaaaagaaagctggtgtagatacactaatttcaaataaagcattaaggcaaaaaggactactagaagtgaaaaggagcatttcattatgccaaagggaccagtccaccttaaatatatcataatcctaagtctatttcatccttaataacatagtttgaaaataaataaagccataaactaaacaaagaaaacacagaactcagaagaggtatgaacatattcacagttacagcaggagactttaagacatccctcttaaatcttgcttaatcaagcagacaaaatctcgtgaagtgtatagaagatctgaacaaagcaatttgtaaagttgtcctaattgtgcaccaaactatcaatagaatatgtagcatttgtcaaaattggccaaatgctggggcataaatataaccttaaaaaattccaaaagcttggagtcattgagattatgttctctaacaatagtggaattcagttagaaatcaagtgaaagaaaaggacaactagaaaagcctcgacttcctacaaattaagtaccttactctaaataaccgtggattacagaagaaactcaaaaattagaaaagaaactggactgaatgttaatgaagatagaatatatcaaaagtttcaagaaccagcttaagccatgctcagaggaaactttatagctgtaaatatataaatttaggaaataggaataagaattaaaaaaattaatgatctgaatttccatctccagaaagaaaatcaaacctagagaaagtagaagaaatgaagtaattaagagcagaaattactgaaattgaatctgtagagaaatttaataaagtaaaatttagatctttgaagagattaatgtaattgataaacttttaactaatggaaaaaatagggtagaaacaaaggacaaatatttgtttgtatgatgaagagcccacagacaatggtaagacaaagaggatgttatgaataattttacaaataagttttgagtaaagttgacaattttctggaaaaatataagtcattcaacattgatacaagaggaattagaaaatctgaatagtcatgatctattaaaaaattaaatttaatgttattaactctcatacagagaaaaccccaggcctaaatggctttattggtgaattctctaaaatgtagtccttatgcaaacccttacggagagtggaatcaaagagaaaactttcaaattctttttataaggccagcataatcttaatatcaaacgtatttaggacagtataagaaaggaaaattatagacagcttttaaaataaatgtagagcacataatgttcataaatattcacaaagcagttgatacaattcctcatgttaacagaaaacaggaagaaaaacctgactaccttggtagtgcaagagaagtatttattaaaattcaatatttattcatgattaaaatttcatagcaacctagaaatggaagataattatcttactctggtgaagattagttgcaaaatgcctgcagcaaaaattataattcctagtgaaattttgacagctttcctcttgatattaggactgtctagggaaaaatttcgtgatacgtatgtcagaactttacacagaaaatcacagaatattatttaggaaaattaaaggcccataaactgaagcatatagcatgttagtggattgtaaggccaagaagagccagagcaatcttgaagaagaacaaaactggaggacttaattatcaaatgttgagatgtgttattagtgctgtagtaattataacattatataggtataaaaatacacaaatagaccaatggaataaaataagagtctagaaacagacctgctggttatctgattcaggacaaaggtgactttgcaattttgagaggaagaggtagttttctcaatagaggatgttgattcatttgggtactatgaaaaataattatattaactcttaccacacaagcatcagttacagctgagttgcagatctaattgtgaaaggaaaaaataatgctcttgggagaaagcataggtgaatatgttcatgtgatcttgtgcactaataaaacactaacgttaaaaaagggctgataacattgtgcttcattacatttaagaaaatttattcatcaaaagggtgccaataagagagtaaacaggtaattacagatttggagaaactcaaggaaacttatatctggaaatataaagtacttacacaatcaaaaagaaaagaccaatatccaatagaaatatgggtaacagtcttgaaaaggtacactaagtgttggcaataatgtggagcaattcaactctcatagactattgttggtaacataaatttgtacaaccattttggaaaattgtttggcagtatctacctgaaccctataacctagcaattccaatcctgtatgtgtatatgtgaagaaatatacaaaaaaaaaaaaaaaaaaaccagaagcgttcataggaacattacttctagtagccccacactgtaaactgccgaagtactcatcaactagagaatggatcaataataagtataatattgttcagcgatgagaataaatgaactaaaaatgtaatggaataatgtatattcatctcataaacacaaagaagccagactcaagtaagtacatactgaatgatttattttatatagaggtaaaaaatagacaaaactaattgatgatgttagaagtcaggctagtgattatcatgagagtggttaataattggaagagtgtgtaagggctatgagttgctggtaacagtttcttgttctgagtgctgattattcaggttaaatttttgaaaactgagccgaacactcatttggtgcaccttttttgtatatatgttaaacttgaacaaaatttttaaaaaagaaataaaaagaagcactatcttctgtttaattcatttcctttacttcacattgtagtgagcccttttatggactcagggagagagagccttggtgtccttagccaggaagattttccttttatcatgcagctctgtccacacccttcgttcagtttctccctgcaactcagctcagctgtcatgctgatgtgaaacaggagctcataagtagggctgttctctctcaagccttcccaggagtaagaacagtggttagggttatgggctttaatggactttcctgctgacatgcagaccacattcaaaatgagttaaaaagtgagctgccgtgttaacaaaacagtggccaggccgaatagctgttgaggtgctgtcaagcttgaaaggaagatttttcttaaataaggagaaattcagagaaggtgccttcaaaaataagaacttgattttggcaggagaataaacaaaaggctttgaaagaaactcagattctcaagcatcgttgtcatttaatctagaatcaactacataacaacactgcaaaaaaagaactgaagcacaatcatttacaaggtctaggtgattttcacatatctatagagaagaaaaaactgacacttataattctgacatgtttaaactttacctgaagattaaattatgctaattattaaaatgtataagaatttgcctttataccgtacagtctttttaatttatctttttctggtgtgtcctgcctcccagattaaattccaaagcatatcctgctggctttgcctacataatatgtccaaaatctgaccactgcttgatcctgctgcagactactagcatttctctcctgggttttggccatagccacctaacaactgtcttgcgcttctgacctttccttgccataggcagagttgatacttttaatctgagtcatatcatgttccttctagtttcaaaaagcctcagtgatttcccattgagagagaagtcaaattccttaccatggcctacaagaatttacctgatttcatcgctttccacctcctaccacccatccaccctttagaaaatgttctttctccagcaagccccttcattcactctgttattctatcaggggaacctgcccccaacatttcaacatagattctttctattttccataagtgttggctggctgagaaataaagagaaagagtacaaagagaggacttttacagctgggccaccgggggtgacatcacatatcagtaggactgtgatgcccacctgagcctcaaatcagcaagttttttatttattaagggcttcaaaaggggagggggtgtaaaacagggagtagatacaaagatcacatgcttcaaaaggcaaaaagcagaactactaataagggtctaacaaagagcacatgcttctgagggaacaggacaaagggaaaaagcagaaccactgacaagggtccaacaaagatcacaaggcaaagggcaaaagcagaactactgataagggtctatgttcagcagtgcacctgttgtcttgataagcatcttaaacaacagaaaacggggttcaagagcagagaaccggtctgaccacaaatttaccagggcggagtttttccccaccctgataagcctgagggtactgcaggagaccagggcgtatctcagtccttatctcaactgcataagacagacattcccagagtggctgttttagaccttcccccaggaatgcattcctttcccagggtattaatattaatattccttaaaagaatttagcgatatctctcctacttgcatgtccatttataggctctctgcaagaagaaaaatgtggctctttttgcccgaccccgcaggtggtcagaccttatggttgtcttcccttgttccctaaaaatcactgttattctgttccttttcaggtgccctgatttcatattgttcaaacacacatgttttacaatcaatttatacagttaacataattatcagagtggtcctgaggtgacatatatcctcagtttacgaagataacaggattaagagattaaagtaaagacaggtgtaagaaattataaaagtattatttgggaactgataaatgtccatgaaatcttcacaatttatgttcctgtgccacagctccagctggcccctccattcgggttccctgacttcctgcaacatcattctgttaggcactactcaaataccattaaggccttccttgaccagcttatgtgatactgaatcctatcaagacttcctttcaccttttccttctttcctcttctctgtagtgattagcatgagctaaaatgttacgtactcttgttatttacattgttgatctttcttccaagttctgtgacagcagaaatttttgtcttttggttcaaaaattcccagtacctgcaacaatgactgtgataggattggtgctcaataaatacttgctgaaaagtaataaatattagcaagagaaagtttaacaatgctatgaaaactgttgtaatattaaaatgttttcaatttggtgcttcttcttggtgctcataaaaaagtttaaaaagtaactttagaacagtattctatgaataaatacattagtttattctaaattgaaatatttatttaaaagttttaagttttgctttgaccttgcatttgacttttcttaatggttgtctatgtttcataatggcatatagaaattatttatttgaattcttattagaataggaacaatttatctactttgaaaggcaaagtgaaattgactgtacagtaaacttcagttattcttaatttctaagacatgagttttatggataattacattttctgaatagatgggagttactatttgtatagcagcttttaaaactgggtctgtcctgaatttcgtagccatcacagccactgtgcactgctttagatgagggttcttctctgttcaaatacaccctgttacaagatactgtctcccagtcttccctccccctcactctctgcccaaagcaatctcctacctttttgaagttcttgggaagtgtttttttttgtttttttttttttaattttaacaaaattagaaaatgatagagaaaatatcttcatttctgttccctccatttttctctccagctctttttcctgctttccctttcttttctcttttaaacataggttatgtagtagaagatgaagacatactcatagaaatgaatagttgttctttgggtacatattgggcatctctagtctcaagatattttaggggtagtctatcataggagcaggataaggccttaggggaaaggagctagaagtaattcagctgtggcatgagggagtgacagtagctgggagggagggctcagtgttcttagatttagcattctttcctcccatcctttcaccccaattatttccattcttgctatagaagacttcactgggggaactggataatagcaggacaggcactaaggctggcagagttagtgggaatggagacgatcagggagcagaggtcttcagcaaaaaaggaaagggaaattgtagagctggaatggggaaggagtcaaaccttagtaattggatgaaggaccaagtttgtttactctttgcatttgcacctgggtgttaatcaccaagtatttgtgaatggtgcagaagatgttctgaagacccatagattaaattggaaatttaattctgatttgttagactgaatagctttaaactggttttatggagaagttgaagaatttgtctatagagaatctctaatatttaagtattgccagttaaaatatacattttaaaaattggttacttgaacttaagtgaataattccgtgactgaatactagctattttgtttgaggctgtgtctgtttgaggggagcagagggggacagaaagtgagttaatgaaatcaagaacattctcaaacagttgaggggttgggatggaaagggagctagtaactacctataaccactagaggcctctcttaggccaagtttcatggttaataccactaggtttccacagcggggcctggctctgccattgtaaattaaacatatgttataattctgaataaatagtatgacagtagttttattctagggcattattataatgtaacctaaatggtttagcttatatatcagaataactgatgatctcgtgaattgaaaacaacaaattagaattattttctctcttctttttctctaaacctttagttaaaaatgtaatcaaagactattgctaggtaaaattatatgtcttcttgaccgtacaaggatatatgggtttaaaattattcttgttacatgttgtgtttaattgttgagagtagtttatatttctgagggtagactataataaagtcattttaagtcatatgttaaaaattatgtgtatttctttcatgcttataataagcctctaatataaaaaaaaactaagaaatgattcaaagatctgttagacttaaatgcttttccttaggcatagggaaaaatggtctcattttgtgtgagtttggaattattttggatatggtttgaccttgcagagaaaacaggtagggcggtgccctcctctcagatgagaatagtttgtttctctgttccaaaacaggatggctgacaatttgaaagttggtccctcctgccaagtcattcttcctgtaggattttctttgtcatgatcacaactagttagttgttgtactaattggaacaagttctaggctgttggatgctatattgggatgtggctactacattgattgtcctgcctgacagcccttggccacttcctttaagtcccatgagggcagggaattttgtgtattatgttcattgctatatctgcaagagtcctgaagagtttagaatatagtagatgctcagtaaatatttgttgaaccatctgaaaaataacgtggcatttggtttttcagtgaaagaaattaaagaactggtaaatcctctaggaagaaaatacactgagattatcagtcatgccatggggtctatttttattatgatttacattttaggtacattttaaagaagattaaaataataactatgggttctgacctaatgttatatatatatactttttgtttttttgagacggagtctcgccgtgccaccagtctggagtgcagtggcacgatctccacactgcaatctccgcctctggggttcaagccattctcctgcctcagcctcctgagtagctggaactacaggcgtgcaccaccatgcccgtctaattttttgtattttagtacagacagggtttcaccatgttggccaggatggtcttgatctcctgacctcgtgatccgcctacctcggcctcccaaagtgctgggattacagacgtgagccaccgtgcccggccaatgtatcttacataataggacttagttcctggtaaatggtaaattaaaaaagttaaaactacatatgttatgcatgtttccttttgtattcaaacagttcttctaattagacatcagtgtcattattttatagggaagaaaactgaggtttggggaaggtggagcagcttacagccagtgggggacagcactggcttcaacccaggttgctggataataaaaattgtcacttgagagttttgctgatcaaatgcttctaaatgtcagcttagaacatattttatcatatgtcaggaattttctttcacatttgcccacctttataatataaagatatgtgttttacaggtgggcaaatgtgacctgtatacaccttgtaaatcacactaccatattttctttcatttagcattttttttccttccacatggaactggagaaagcaagattaaattatataattatattgttccatttcacatcccacctgatgtgtttttggtgtcctcttatacacttaaattatttgagtttgactcaagttttcattttgtttaaactgtttgctttcactgttacgaatagcagtgaaaagaaagaaatccgttacctcatttcataatgaaaaaagattataggtacattatgttcttagtttaacattttaggtgtaatacaagaaatctaaatgtgttgactttctgttctttctttgatggcgtttaactctctcccattaaactggtgctttttttacgaaattgtatttattctgtaatcgttaagaatttcttatcttttctattataacaccctggctttgcagtgctgagcagtgataatttaacttaaaaatttattgaaactgtgatgtacaaaggtttaacaaaaggatattacttttctagtttattccaaaactggggccagctatggtggctcactcctgtaatcctagcactgagcctgaggcgggtggatcacttgaggtcaggagtttgagaccagcctgaccaacatggtgaaaccccacctctactaaaaatacaaaaattgctgggcatggtggctggcacctataatcccagctactcgggaggctggggcagagaaactcttgaacccgggaggcagaggttgcagtgagccgagactgtgccattgtactccagcctgggcagcaagagtgaaattccatctcaaaaagaaaaaagaaaaaaacaaaacaaaactggggctactcttaccagccatgaatagtcaatctttccaaacacgtactttctgtgctttcatttttttcttctaggaacttggtttgtttctttacgtgtttatattttcttttatgtgtttaattaagttatatagtttcttacataactatttcacatctcaagtttatcttttaatattctatatttggcattgtgatcatatcattacagttttttctgtatttccctttcctttttcttttttgaatgtggcagaagagatttaaaaattcaagcaatccattaacatagcactaaaacacacagtacaatggagcttataatgcaaagtatcatcttccttccctgcccctactccctaaacacagccacttttaaccatttctgtattttattcttctgaaggccacttccatatctctagcaatacattgcacagatatttctgctataatggagtatatacatttctgcagagtaaattggattctccatgcatgctcactaaaaataacagggtttatggaaagaaaaagtgcgtgtagcaaaccacttaaaacagcttggtaactagagcgaagaagggtttttaaccagagtcaggaaggattgagcctgttgatttatggagttcagggcaaatgcatcaaagttggggagaaagatgtaataaacacttctaaatcagagcagatgggccagcctgagccaagagacatagtgcatggtactatatttctctgaggcttgagtcagcgctgtggctctgctttgcgttttgctttgttcctaagtggcataaaacaatgtgctggggcagattgtacatatgccaacacgactaggttggttgccgccacttctcactggaaacacatttcatacttgtgccaggaaaatggacttttccttgctcagtccattccctcatgtgtttcactgctgagttaggttttgtcggtggagcctgggtcacatctttatcttggctataatggaggctggaaaacatagtttttttatattctaccttgggaaagtggaattcataattaggagaactatcaaaatgtggagaatatgttaaaaagttttagatttttcaggaatcagaagcctaccacacgcacatgcactcatgcacacacatgcatataggtgtatacacgcacacgtatgtgtgtgtttcaatgtctgtaacttttgatttataaattttaacataatttattcaccactatgacacataacagtttagtgggcttgcattccctgctgtcttcatctcatatttcctcagttttgagttatgatattacctgtattttattttttctactgattacctctttattgtaatttattttaatttctatatcttactccattaactttgcttagaatcttttgacctctcactatgtaagaagatgatgttaatgccctctactcctatatccactgttctttcctcccttccaattcccattttctgtcagctgattatttttacattgccaagactgagaacattacattgttttataaccgaaatgaaataattaaacccttgattttaaaagttgaaaagcagtacacactgttaatattattatgataacaaatatttttcaccactgttgggggtaagattttatttttcacttgaggtccagtgcttggtctttgggaccctaaaaggagattctcttggcatctagatcaaatggtttgccttttaaattagtgcattaactgttcaatgtcttgccacattctgaatgtttcatatttgggctgtggcattcttttagatccttttggattttttagttttaattacctttcattttctctttgaaaaatcaagacaagcctttaaaatatcttgaagatcactcatattcttttttggaatttactctttttttttttttctttttttggagacagggtcttgctcttgtcacgcaggctggagtgcatggtgtgatctcagctcactgcaacctctgcctcctgggttcaagctattctcctgcctcagactcccaagtagctgggattgcaggcatgcaccacgatgcaccactaattttgtattttttagtagagacgggatttcaccatgttggtcagtctggtctcaaactcctgacttcgggtgatccacacacctcggcctcccaaagtgctggaattacaggcataagccaccgcacccagggtactcttagttctctaatttccttttccagtcttgactacccttctctatacctgctgcacaacaatcaccagggatgtttctccacttcactcttaaaggcaccatttcctgggtcctgcgatttgctcttccatggttatctttctcattttgttggagtacattcataattaactttttaaagcaaagggcatattgggtgcaggaggttttctgacacttgtgttaggtaaaatgtttttatttggactcaacatttgcttgatatttggctgcgtatagtattctaggttcacagtaacttttacttaggactttgaagataatgcttcattatatactagtgtcacattggggtagaaaattttgatgccaccctgattcttattcttttatacatgatctctctgtgtgtttgtttttctggaagcttttgtgattttttgatacattttatactgaaatattacaggtgtgaatctaaatatgagtctgtttgactcatcttgttttgcctctcatgactttcctctgggaatggcctacatatttaaggataattatattctttcttttttttgtatattttcttttcaaaaaactcttagcagttgtatgatagacctgctaggttgattctgtttctcatttcttctctcctagtttttgtcctgttgtgtttttacagtgttttgcatatttcctttattgtatcatttaattttttttgaatatttcaatctcatcaatcaaaatttcccccttgtactcagttatttttgtatcatgctatttgttttttttttttttttgtcatgtattttccttcagttgttacgggtatatacatttttttcaagttatgttctatagattatctctgtttctttagtagtgttttttttttttttttttggtcatagttcttttcttcatttgtgattgttgattattctggatacctgactggtgcagctttcctttatgtctctttcttctctaggcttttccactatggaaaaagttgcatagatctgtgcacatggatgagacattgctttagggtaaatgaatgagaagttcatccttaggcagaaggggttgccactaggttagcaaatgggatactcttgattcttggacatcagtgctcataggataagcctgtctttgtaggcaatttgaatgctttttatcagagactagctctttttcttttctttttctttttttttttttttttgagatggagttttgctcttgtcactcaggctggagtgcagtggcaaaatctctactcactgcaatctccacctcttgggttcaagcaattctcctgcctcagcctcccaagtagctgggattacaggtgcccacgaccatgcctggctactttttgtatttttagtagagacagggtttcaccatgttggtcaggatggtctctaactcctcaccttgtgatctacctgccttggcctcccaaagtgctgggattacaggtgtgagccaccgcacctggctatttgcctgattatctctggcatcatgctttttatttgggttttatttgggggaagtggagcaattgatacaactgtgttatttaattctgttgtttttattctcaattcttatactcacctctctacctgctcatgagctcatcttctctctgggagattagctgtttcttccactgtacctccatttatctccgcattggcttcctctactctttgtttatattttcatcacacacccacaaaagacttgttcagtctctcttgtctaataatcactaccccttcccgactttgttgtttttgctgttacaggtttttccttttgtattcatgtcctgtcttgagagaaaagggacatgaaagcgtatactcagtctgtcatcttgaactggaaagttttctctattgcattttcttattttttaataggcagcataatttgtgtatcttagtctgtgtactgtcatttcaccaaaatcttatttattctaatagtttctttattggttttctgagattttctaggtgggtaatcatattctgtaagtaaaacctattttcatctcttcttttctaatctatattcttattttttctcatttgtctagaacgactgaatgatgatgaatgaaaaaaatgatagcagacattaaatgtgatatttataaggcccaatttgaacttattgaattattaagtagaaaattgaaagtatcaacttcattgtatagatttctggcttactgagaaatgtatcagcaattttctgcataattagtgtttttgagtaaaagaatttggcacttacagccaaataccgagtatcttatatgtttctttttccaatagccacaattcagaattgggcttcctaaaacagtgtatccttccaatggcgtttcctaattttattattattttttaaaacgttttattttattttagattcagggggtacacatgcgtgtttgttacctgggtacattgtgtactgttagggattgggcttctagtgtatgtacccattacccaaatactgaacattgtacccagtgggtaatttttcaaccctttccccactctcaggctccctcctttcggagtccccagtgtctattatttccatctttgtgtctgtgtgtacctattgtttagctcctacttataagtcagaacatccagtatttgattttctgttactgagttagttcacttaaaagtttacctaattttatatgacaaagctggcaaatcactgttgggcaacatgattaatgttattgcaataagtcagttaaaaacaagtcatttaattggcagctatgaatcttcaactctaaagccaataaagatccagtgaaacaacgattactagaaagatacctgcatttgaaaaatatgcccctcctgattgacagctaaagaaagactcattgcaaaaacagactcattgctttttcctctgtcccttctttccctggatggatctaagatctgataagtctttcaacactgagtttacaggtttttttcttcatggagctgttcctgatctttttttcccattgtcttttaagtctgccttggagttgtcttcttagtgttcccgtggcattttccatccatctgtttcagagtagatatcccttagtgttgtaatttttaatatccttatctatttctctctaagagattgggtttcttggaatctcagttttttaggatgtggctaagaatcgtgaagtaggtagaagacttctaagcagcttgaggtgctaccataaacccatgtataaaagcacatacatttagtctataagagtggctactaggcccttaatcatatcccatcaactgttactttacatagaattctaacaaactttttacttagtttcttagcccacattagattggaagcaacacattagaagatggggaaaagttatgttgatgaaggtagggatgttggcaagatctaaagatgatatattgatagcctgaaaataagataactgatgggaaaagaaaaatctgttaaaagtacaaaagaatatagttttaaaaatcacagccattcatattcatttaatatagaaacaaggtaaacatctaccttgatagcatagtattataattgatgttccaaattatatctatcattgtgaagagattaatttctgttctatatgctgtgtttgaaatacaatattattgcttaaggtatgagtggggtgaactctcaaatgtgttgaataactcagccccctacagtgctagataaatgagttcttgttggtttctttctaaaagctgcagggtactggtgctttgcttctaatcattaattttcctttggttacattcacattaataataatgtcattaagtcatcttctgttagggcatttttctataaatttctaatttcttatgtcagttttggaaaataataaaatgacccctttctcttggctcttactattttttctttaattattttaatcatggaactacttatgaatttttctggtagaagccttagtataccattaattctgatactattttgcattaactctttgtgatattttctagacattgctttagctggattggtgggcaggaaaaaaggaggcgattaatcctccatttctgtagattgagattttgaggtgtgacagatacgatatgtagtaacagtactgcaaatccctgtgctggggcttgaaactattaatcttgttgtgaatcatatgagacatgtttcgtatgtctctccgtgtggttaaactcttccaggggagcttgggctggtggtgccaaagggtggagggggattgactaatctgttaaatagccttttatctgtgagtctagtttctcattagtatttctgaccagaagaatagatggttggaaatgtggacttttgtttttaattagtccctctagggatgagaggcttatttggaagaatggaattttaaggaagcctgacaacctcagtttccatgtgattgaaaatgtttggcagctgaaaaatgtttcacaattatgagttagagccagattttccactggctaagctgttctttgggagttagatacagggtaactcatatttccactttcaggtctcagtggctccgtttagggtgctgttcatgggactctaatgctccttccttcccaatggcccagaaggctcccatgaggtttattcttctatcatgtataataaactgatgaaataaccatatttcatctcatatttatgcattttaatcaggttggttgatgtttaccacagacatatgtctacaagcatttcattatctataaaagagagatttttttctttccttttttttttaaaacaaggtctcactgtgttgcacaggccgcagtacaatggcacaatctcagctcactgcaacctctgcctcccaggctcaagtgatcccccgacttcagccttctgagtagctggtactataggtgcacaccaccacacccagctaattttgtatttttcttttgtagagacgggctttcgccatgttgcctaggctggtcttgaactcctgagctcaagcaatctgcccacctcagcctcccaagttaagtgctgggattacaggagtgagccactgtgccagacccccaaaaagatattttcttcctcttttatactaccataaaattataatgctactgtattgccacagttttacaactgagtcagttttgcccaagatcctttgatctagccaaagttttgaagtagccaaaagtgcacagactttggaagccacgcagttcatctccctgtgcacttcaaggtgacaccctgacagatggttgctgagcacccactggatttttcccataaagtgaggcaaccagttcttttgttgtgcggttctagttgttacagttttccattgttgaactgaaatttgcctttctctaacttccacctattgattcttattcttccctcttgtatgtaacttgcctttgaatattcgaagacagcctcctcatagtcctcttatatctaggttaagcattccatccgttcctttcaggtgttatttaaatctcctggtttgcagatgcaccactattctgactaccattttttggacatagtctttatctctgatggcctttaacttaaaatggcattaaaatggtcctttagatatggcttgagtagctgaatgcctagtagagctgttttcctagaaggagatatatactttctatacttctgttttggaatacctgaaaagatagtttcttggcattggatatgttaagcagatgcacatatgttagggatgttgtagacaaaaagtgaataaaaagtatgttgggagggtggtgtccttacaagaataaatttaaatggctgttaatttttaacagcactattatgaaatatcaactataaaatatagggcatattacagtatataatgttggtaataatgtctgagtgaatattcttttcttagaaggtcacttaggtgcttttgttttttgaacaattcctgaataaacttgttagagtactttgtatctgtgaaagattgcatcccttgtcaaaaactttcaatttcacaaaaattccatcaacattttcccttcacagcaacatgatagtgctttaattttctcaatgtttggccacattgttaacttatttttttccccacttttcttcattctgctccttcctttgaggcagtgtttacttgttctttatagagttaacatttggtgcaatacaactagattgttagaaacttttaaaaaccctactcagtattgttattagcattgttttgtccattaccaaccattcacctgtttcctttcctaggataatgttaactgtgctttattagatgctctcagatatttaccaatgacatttttgtaaatggaatattgtttactcttaatcctaaagtttactcttaatccttaatcctttggaatgtctgttgaccttactgtaaatttaaggctgtataactgatagatttcagcaaattatggcagtgagagttttgatggtatctattttatgtcaagtaattcttcagtgactatgttaacatttcactgcattgtgtagagtcttattttgtttttccatgaggtaatttttaaaactacagggctattgagagatatttagtccagtaatacattccatataggggcattcaacgagaagattcttgtgttacaaggaaaggatgttaaaaaaccagaatctctcagtaaattgtggtctgtaacaattccatccctggggaagggcggcgcattgaaacttccatgactattaatcttgagagagagcatgcattgtcttgttggactgaagcctctagccatcttatcaagccagagctacaaaagtaggataactttgcatccctttttggcccactggtgaaaatgaaaatggtaggagtggatggacaatagattaggttctttgacaagtaagtgttgagtgacagtcatgaatatttcccatttcttgattttaccaattgtgtctctaaattcactcaccagaaatatacaataagaagctgaattttcttggattacttaacttgttttagtgaatgggtgagaaaggtttccagctgtagctgtcaggtttttttctgcagcaggcgcctgccttcagcgtttttgaggataacacgatacactctttcttcttttgctaccattaagcatattatgctgccttttgtaggcaggccaccaggctataagtcggactccgtagtctggttatgagctctgaggcatggagagggatctctggccctggcttttctactggttgctggatgaccttgggcaagtgagtcaacctcttctttatcttctttccactttgtaaaactgagactttctttttttctctagtcttaaaaaaaagtttgcaaccattaaatataaagggtaaacaagagtttcttgagtaagttaacacctctctggatactttagttaatatagataggattacttcttggattactacagtaaattaaacaaaatactctacatgcatttaacatgtattacagattgtctatattaaataaaagatgtaagtcgtgtctaatttgtagaagttatttcagtttcttttggaggaaagcaatgtagttatttatgttgtccctgtaagttgtattacagcattagagaacttctggggacactgaagaattgtttagtcacttaaacccttaaactccctttagggagtccagttgattcatgtggaccctccaaattatctcgtttcccaaattttaaaattgcattgggattatttcatctctttagggcttttttacttttcaatttaattttgctatgttttaaaaaaactagtggatgaattatgctcactctgaaaagtatttgggttccagtttacataaatttaattccagttttgtgtcccagaagtatgctatgtctttaaaattcagttagctcattaacactccagttctcatatttgagtgccctataaatctgtatacttgagtaacctgagctgcaatctgaagttaataatacaatctgttcttaggtatgtgaccgtaaaattccttaaagggagtcctgtgtttatgaatctgaaagtgttgagcttgaggtaacagtggggctaacatcttatgtgagggtttaaaaattataataatctactaatggtagagatgttttctaataagagtaattctgtgactcattttagttcccttgctttttattcctgtgagccatagaaagaacccactgtagggggttagaaatattttttcttatgattgtgggatgaaagagtggttgctttttccaaccaccatatgtggtgattaggcttttcagaatgacattggggtacacactgagcatacagcaacagtcttccaaataacttataataaataaagtatgtaagacgtttcccccagccagatgtaatcttcaatagtagaggaataaatttaaagtgacttcccacaggaaaatttgggaaatgcctggatggaccaagaaggcagtcatgctgttagaaataagcaaactcctttcctcctttcaggtgagaatatatgatggttcatttaaattttgtttttgtgatttctgggatttcttagaaaatgcatggataaaaccaaaaaactccagtgaactaaaagtctatttgaactgtttgaaccttgctttgcatttttgcttccaatattcaaaaacatttaagcagatggtactcagataagtgtggggacatctccctgagtgtgtagtaacagatctaatttttgtaaattgaattgtactttacatctaatagagacagcaccagttcctggggattcttgaaaggtggcaatctaaatcacctttattttctgagcttcctctcaggtgcctaaaacagcagcttcagaatttctgtgaggatgaatatgggtgttgaagtgggagatagctagagaacttgtcttgaaatggcattttgtttttcacagacagtgctttgagatgggttttatgtttatttaggtgggcttggggtggggggttttgtgatagccagcctttggtgcttgtactactctcaaaccatacccgagccacatgtgcaggcatgtgtgtagagacttgaggtgtactgacccaacttgtcaccagcctgggctctcagaaggtttcagaagtttgttcttctctctgctcgatgggagttaaaaagtatagcagtggagagatccagtgtgagggcctggacttccaaccttccagggagagctgggcttgggagactaagaactcctcaggtatgcctgaacatgcccagtagtctatagcaaggactggccactgaaacacaacagaagacatcctgccaaactagcatctcctgaaggcattctcgttaaaactgtgtattccttccattgtttttttcatttaacagatactcagtgagcaccttctgggaccatgtgttctagaaatggagaacaaagtaaacagagtagaaaatattttgccctcttggagcttagacactattgcaggaggcaatcagtaaacagatatactaatacatatttaagtcagatcccaataaattttatgaagaaaaatgaagcagcttacagaaatagcagagtgaagggaagggctatgatagatggttagatgatagttgtcactgaccactgctctcaggtggtgccttttgagcagacacttggtatctgagaagaagagttggcagcatgatagcatgtgcaaaaggcctgaggcaggaatatgtttgtcctattggaggaacagcaataagcttggtgtggttgtagtcgggtaagcaaagattgtaagagatgaagtcatggaagtaaccagtggaacaaaatagggatgtccattcttatcattagtaatcaacattatgctggagagtctaaataattagactagaaaattgaagagttgttattaaaaaaaaagaaaaagtaaaattatttgtattttagtgaacatgagtttatgcttttgaaatctagaagactttcactaaataatttagaatcaatgaaataattgagagaagaagcttgaaatacaatgactgtttataaaatctataggttttcctcatattattagtaagaaatagccagaaatggaaaatgacaaagatatcctatttataattgaaactataaaatactttagaataaattttacaagaaagaaagacagtggatacataaagaaaagaataaaatcttaggaaggctgttaaaatcagactaaaatatactgtgttcttaggtattcttaaacagtagcacataacaccatttaatacaaccccaatttgaattccaaaggggtttttaggttgttttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaggtttttttaaactacctaaaaatatttaaaactatatataaaaaatacatgccccaaatagccaagaaaaaaacagtgaagaagattttctattgcctgaaattaaaatttactgcagtgccatgtaaacaagctatggctgggatttgacatatggaacagggggttagcaattttttttctataaagagccagatagtaaatattttcaactttgtgggctatatggtctgtcttaattattcaactctgcccttaaagcagtgttttagtccattttgtgttgctgtagcagaatgccactgactgggtagtttacaaagcatgagatttatttcttacggttctggaggctaggatgtctaaggttgaggtgcctgcatctggcaaggaccttcttgctgtgccatgatgaaggaaaagagagcacgtgcaagagagagaaggaagggggccaaattcctcctttttcaagaacccactcgtgataaagtcattctgtagtgacatgagggctctgtcatgagagcttcattcatgagggctttgtctaataacctcttaacagtcccaccaaacactattgcactgagaattaagtttccaacacatgaactccagaggacacattcaaaccaatgcaagcgcagaagcagttgtaagtaataaataaatcagtggatgtgactggatctcttcattgccagtggttggccaattcatgatgtagatcttaaaacaaaatagtgctcagaaatagataatatatggcaagagtgctatttcaagtcacttgggaaggatagtttactgaataaatggtgctgacagtttatgtaaattctacttaattatacatacttaatgtatgatgctttaaatataaaaaccaaatagtaaaacaatagaaaaaaatttaagagaatattgttataacctagtgttgaagcaaagtttttaaacaaggcagaaaatatagaagctataaagaaagtatagatatttggctacataaaaaaggaatgttattatgtattataaacatttataaacaaaaataaacaaaaataaaaatggtattctgtgaaaaatatttgcaacacatataacagaaaaagggctattttctttacatccagtgtgcctctagaaatgacctagtaaaaacagggcaaagaacagtttctgaaaagaaaagccaagtgggcaatgactgtaggaaaagatgctcagtatcatagaagctgtaaccttttgtaaaatgggatagtaatagtacccacctcttagtgctgttggaaggattaaatcaaatcatacaaataaagtataagaaagtggttggggccaggcgcagtggcttatgcctgtaatcccaacactttgggaggccgaagcaggcggattatgaggtcaggagtttgagaccagcctgaccaacatggtgaaaccccgtctctactaaagatacaaaaattagccgggcctggtggcacgcacctgtagtcccagctacttgggaggctgaggcaggagaattgcttgaacccagcgggcagaggttgcaatgagccgagattgcgccactgcactccagccagggtcacagggcgagagtctgtctggaaatcactgtactgctgcaaactttctaaaaacagagtacatgtagttcactgccttttccaataaaccttttaaaatttattctgttttttcaacttagcgtcattacagcataatcttttggtgtaggttataataccaaaatgctttcagagaattaaagtatagggatatttcctacagcatccctggattttggatatatcctacctgcttattatagtggctcttttctcctttactggtagactgtcacctgtcacttccctgtgctggctgtttagtctaatgcactatagcactttctttaaccctttttttttttaatctctacttctgattgggaaaccagagagctaaaatcgatcaagatcaaccatagaactgttaacagagagaggaaagtaggcattctttacaattaataaactaattatgattttgtagtagatctattttataaatctaaatatgtatcagtatttttccaaacatctcatcttttttcagagaaatttactgtggggctcctttgaatagtagaatcccccttttcagttatatacatacatgtttatattctctctatagcacatatacatttgtatatgtatgtgtatatatatactgtatatatactacatgtattaaattctccttatggtatggttactatgtaaatcacctgtaaataaaattattttataaatataaatataaatgtaaatatttaatatatttaatattatattaaagagatatgtatgttctatatagagatatgatatatgttatagatataacatctatatctgtgttatatatgtatgagagtgtgtgtatgtgtgtttgtgcgttctctttctttatggcaagcatattaaaaaaataacagaaatccaagacaaaaattgcttgagtcttttaatcaagccattatcttcattttcattcatgtcactatgtgaatgcataatttgcatagtaatatgtaggaatatcatgagtagattttaatactttatattttcatttaatgcttttctgctgtcttttgtttttaaagttgtttcttcctttctctcagtactccctgtgcacaattgacatgtccaatactcatgcttaatatgcttgtttttatattttcaggtatgaaagacttttttggacttaatcattgtttccattttggcaccatttttgtccttatctcattaacatagtaagcctaaaatgtcctaattccaggaacggataaaaattccattccattttatattcaaaggtttggatttctaccttaatccatttcttaaagtggctaatgatttttattaccctagttgtctctagggcagtagcctttctcaaatcattttagtataactttacaaaatgaatgctgtaaatatactatgaaaccttcttgagatcattcccaactaagaatcaaaattagtgacttatctaaacattcacattcttttatatgttgggaaagttcacatcattgctcttatctgcctctaaattctttctctctggatcgatagtttcctgctggttttcagaatcaagtgcttcttatttttctgaaccttattaatcttaattaggcctccctggctctggggattatttagaatttcttcaggtaaaggtcacacctatttgtagttcttaatctttgcattttatctactttgcgtgtcaaatgttcaatgaaatggagctctactgtagggactcaatttgttagactgagtactctttcacgatcatctacatacatcaggttttattcagagacttctaaaaggagctatgatttttagtttctgaaattccaaaccccaataagccaaacagaacataaataaaaatagtcgtatagagcagcacttcccaacctttttggcaccagggactggtttcatagaagacagtttttccacagactggaagacaatttttccacagactggaggggtgggaaatggtttcgagatgaaactgttctacctcagatcaccaggcattagattctcataaggagcgtgcaccctagatccctcgcatgcacagttcacaatagtgtttgcacttctatgagaatcgaatgccactgctgctgctctgacaggaggcagagctcaggcagtaatgctcccttgcctgctgctcacctcctgctgagtggccaggttcctaacagggcagggaccatactggtccatggcctgggggttggggacccctggtataatggatgtagtatcagtcaccacagtctcctgccttattattccatgaagaaaccaagaaaatagttttaaaagaagattgcgactatttagtttagaacaatgtgctaggtagagacttaactttttcttggctattatcacagatagaataggaatgtttatgtgctcagctggaggggtggcagtttatatttgtatataaatatagattgggataaaggttttgaacttaataataaatggtgtcttaagcttacatgttttagttttcagagcagattatactaacagcagtaacaatagctatgctgagaagaatgcggagaaagaggaatgctcatacattgttgatgggaacataaattagtacagctattatgggaagcagtatggagactcccagaaaactaaaaatagaactgccatgcgacccagcaatcccactgctggctgtgtatactaaaaaaaagaaatcaacttatggaagagatatctctgctcccatgtgtgttgcagcacaattcataatagccaagatatggaatcaacctaagggctcatcagtggatgaatgaatgaatgaagacaatgttttatatatatatatattagactattattcagccatagaaaagaatgaaatcctgtcatttgcagtaacatggccggaaagtcaggccgaggaagacaaatacatgttctcattcatatgtgagagctggaaaaatgatcttatggagctagtgagcagaatagtggtaaccagagtcagcaaatagtagggggagtggagaatgaagagaggttggttaatgggtatcaaaatacagttagaagaaataagttctagtgtccagtaacacagtagggtgactctagttaacaagaatttattgtatatttcaaaatagctagaagatctacaatgttcctaacacaaggaaatgatcagtgtttgagatgatagatgtcccagttaccctgatttgatcagtatgcactgtatgcatgtatccaaatagcatatgtgccccataaatatgtacaactgttatgtgtcaataaaaaacaaacaaaaatagctatttcttctaatatcaggcattggtcaaacaaatatacttgcttctttttataacctcataacctaaagggatagttgctgttaatcatttccattttacttttgaggaaacatgtatttagacaagttaagtaactaacctttggataatcactgaaaacatagaagccagctcccagaataatatcttctacaaagtagaagagattatttttgaattagtgtctgagctgggactaaaaatctaggttaatctgatattaaacccatgttcttgatctttgaggtacatttcttctcacttgattgccacattaattatgtccaaaggccagtggcacttaggttctatagaaatatttgtgtggaataaaaattgtgttctaccaattctccttgcagttgcttgtgtagtggataggataatttaaaatcatggcctggttcttgaacaatcttattttgtcatctttgagttttatgaacagcagatggcaacaggacaatggtcagtcagcttgactgagcagtgaaactttgttcagtgagcaccggcactgggaacaactggtcagtcatatcattcagatgggaatggctctcattagctttgaaactcagatattaatgactaattgccagtaagatcaggcaatgctggtcaaccaggcaacttaacctgtgctccatgtggaaaggctgcttttgcagccttttaagtttggttgtaaaatgtaaaattaatttttcaatctcaagtttattcagaattctattaaaaacaattgttctttagccattttggtatgctgttattctttaataaaatatcagactgtgaattattgcctcttctctttaactttgtgttgctgtgttcccaaagtactttatccatataatgaatgcattacatatattatggttatttgattacatgcatattcccagcttaaccaaggactgtttgaaggcagggctgttttatacaattttgtatttaacaggtaatagacttttaggtgatcagtcaatgttgaactaatttgtactgtaaaatgaaagtccactgtttggctctgttgttcataatgtaaatattcatttacttaaatttaactgaacctatagtttagctggaaaagtgaaaattttatctaagaaaataaatgtaagtttaggtttctgaggctgtctattgtttacatgggtaaaaagctaaagccctcactgtacagctatttcaaatgtttaacatatatttactcatttattccttacattagcagaggtagttacattgaaaatactgagtcattgagaggttgagtaactggccccaagacacatactaacaagggttgagctgggatttgaacccaggcagtccaattccagagtctgtgctcttaaccaatattctatgcagcctcatttatctgttatgtgtatgtatgtaagtcaatatgtacagagagattgaaagagactttatcttatattttatagtgaatgttattatcacttcttggaaaaatacagaattttgcagaggaatgtatagttttctaaggtcaactttcaacgtcaagtaaaataatttaaaaaaattttcatgtagatatactttgagagacatttagatgcagtggaatgggtttggaaaaggaccaacaaaagaataaggaaatataaatcatgctattgtagaagacattgtaaacatttcattctgagagaattttataagggaactgcaagtgtttttcagatatttgaaggtagaaattgagagagtttggctttgttctttatagttttggtggacaaaattaaagtctttggtagatgctttagagcaataggattttacaccatttaaggaggaaatttttgcatggaaggtggccttaggaaataatgagcatttttctatcaggatgcttagatagaggctgaaaacagggatgtcactgaggataatcaagcattcggctgattgagtaactgaactaggtgatcacatttaagttaccttctaaacctgcaacttaaagattctaataacttagaagggattctgttttattaatttactatgtaggtgatttctagtgaaacttatgatcattaataccagtggttgcgaaaaaataatgcctgttacagaattattcataataagctcatggaaattcactcatcatacttagtgtttattatgtgtcagataccttgttaagcactttatcatttattacctttttactcttcacagtaaacttctggagtgagaactattattgtcttctagatgagaggttcagaagtgcccatgttcacattaaccagtaagttggcatggccagagcttgaacccgaggctttctgactccaaaacctatatgcctaactactgcacaacctttcaactttctagttcagatcagaaattgaaaatcaaggtaattaacatgacaaggttctcagaatatgatacttttgttatttacataagtagaaaaggttcaggccatccctatcagctggagcagactgctataaaaaaaaggaagaatgaaatagaagaattagggaaaggaaagagagcaaggatgttgtgtaggaactatttcatgtctagttgaaatgtgttataaaacttaaataggttttttaaagttctgttttgggtggcataaatttataaagcaaaattccttcctccctccttcgcttccttccttccaaagagtattgaggagattttaatcttttttaaatttttattttattttttgagagtctcgctctgtcacccaggctggagttcagtggcgtgatcttggcttatagcaacctccgcctcctgggttcaagcagttctcctgcctcagcctcctgagtagctggggctacaggcgcatgccaccacacccggctagtttttgtattttttagtatagactgggttttgccatgttggctaggcttgtcttgaactcctgacctcaggtcatctgctggccttggcctcccaaagtgctgggattacaggcgtgagccatcctgcccagccttatctttaaattattcagtaaacaacagtcaaaagaaaaatcttagccacattaagttaatagagttcagttgagcaaataacaactcgtgaatctggcagcctcggaaaccagagtaggctcagagactctccagcgcagccaagtggtggaagattttgttttttcactctttttattttatttttatttatttatatattttttattttttattatactttaagttctacggtacatgtgcacaacatgcaagtttgttacatatgtatacatgtaccatgctggtgtgctgcacccattaactcgtcatttacattaggtgtatctcctaatgctatccctcccccctcctcccatcccatgacaggccccagtgtgtgatgttccccaccctgtgtccaagtattctcattgttcaattcccacctatgagtgagaacatgtggtgtttagtttgctgtccttgtgatagtttgctcagaatgatggtttccagcttcatccatggccctgcaaaggacatgaactcatccttttttatggctgcatagtattccatagtgtatatgtgccacattttcttagtccattctatcattgatagacatttgggttggttccaagtctttgctattgtgaataatgctgcaatgaacatacgtgtgcatgtgtctttatagtagaatgatttataatcctttggatatatacccagtaatgagatcgctaggtcagatggtatttctagttctagatctttgagaaatcaccacactgtcttctacaatggttgaactagtttacactcccaccaacagtgtaaaagtgttcctatttctccacatcctctcaagcacctgttgtttcctgactttttaatgatcaccattctaactggtgtgagatgatatctcaatgtggttttgatttgcatttctctgatggccagtgatgatgagcatttttttcatgtgtctgttgactgcataaatgtcttcttttgagaagtgtctgttcatatccttcgcccactttttgatggggttgtttgattttttcttgtaaatttttttaagttctttgtagattctggatattagccctttgtcagatgagtagattgcaaaatttttctcccattctgtaggttgcctattcactctgatggtagtctcctttgctgtgcagaagctctttagtttaattagatcccatttgacaattttggcttttgttaccattgcttttggtgttttagtcatgaagtccttgcccatgcctacgtcctgaatagtattgcctaggttttcttctagggtttttatggttttaggtctaacatttaagtctttaattcctcttgaattaatttttgtgtaagatgtaaggaagggatccagtttcagctttctacgtatggctagccagttttcccagcaccatttattaaatagggaatcctttccccatttcttgtttatgtcaggtttgtcaaagatcagatggttgtagatgtgtggtgttacttctgagggctctgttctgttccattggtctatatctctgttttggtaccagtaccatgctgttttggttgctgtagccttgtagtatagtttgaagtcaggtagcatgatgcctccagctttgttctttttgcttagaattgtcttgggaatgtgggctcttttttggttccatatgaagtttaaagtagattttttccaatgctgtgaagaaagtcattgtcagcttgatggggatggcattgaatcatgaagaaagtcattgtcagcttgatggggatggcattgaatctataaattaccttgggcagtatggccattttcacgatattgattcctcctatccatgagcatggaatgttcttccatttgtttgtgtattcttttattttgttgagcagtggtttgtagttctccttgaagagttctcctcttcaaggagaatacaactcacatgccttgtaagttggattcctaggtattttattctctttgaagcaattgtgaatgggagttcactcatgatttggctctctgtttgtctgttattggtgtataggaatgcttgtgatttttgcacattgatttttgtatcggactttactgaagttgcttatcagcttaaggagattttgggctgagacgatggggttttctaaatatacaatcatgtcatctgcaaacagggacaatttgacttcctcatttcctaattgaataccctttatttctttctcttgcctgattgccctggccagaacttccaaccctgtgttgaataggagtggtgagagagggcatccctgtcttgtgccagtttttaaagggaatgcttccagtttttgcccatttagtatgatattggcctgtcttgctaggttggggaagttctcctggataatatcctgaagagtgttttccagcttggttcctttctccccgtcactttcaggtacaccaatcagacatagatttggtcttttcacatagtcccatatttcttagaggcttttttcgtttctttttactcttttttctctaaacttctcttctcacttcacttcattcatctgatcttcaatcactgatacccttcttccacttgatcgaatcggccactgaagcttgtgcatgtgtcacgttgttctcatgtcatggttttcatctccatcaggtcatttaaggtcttctctatgctgtttattttagttagccatttgtctaatcttttttcaaggttttagcttccttgcgatggattcgaacatcctcctttagctcagagaagtttgttattactgatcttctgaagcctacttctgtcaactcgtcaaagtcattctccatccagctttgttccgttgctggtgaggagctgcgatcctttgaaggagaagaggcactctgatttttagaattttcagctcttctgctctggtttctccccatctttgtggttttatctacctttcgtctttgatgatggtgacctacagatggagttttggtatgagttgtcctttttgttgatgttgctgctgttcctttgtgcttgttggttttccttctaacagtcaggaccctcagctgcaggtctgttggagtttgctggaggtccactccagaccctgtttgcctgggcatcaccagcggagggtgcagagcagcaaatattgcagaacagcaattttttatacatatttctttatgtatataggcaatatttctggtaaattcctgggaatgaaacttctcattcctacattatcagcattttgaactttagtaggtattgtcaaatgattttacagtagttgtaccatttacacgctcaccagcagtatgtgagatgtcctgttgtgatcaatctgattgtgtgaaatggtatcctactgggtttaaatttgcctttctgtaattgctaatgaggttgaacatcttgtctgtaaatttgcttccacttttctattgggggaaaatttttcttactgatttgtggatttctttttattatttggctaagaaacctttatgagttatatatacattgcaagtatcctttctcagtctgtggcttgtgttttcactcttttaatgttgtcttttgatgcacggaagttttaaatttttctgtggtcaaatttattcatcttttcatttatggattctactttctccgtctcacttaaatccttccttatcacaagatcatgaagatattttaaaatattttgaatagttttaaagttttacctttcaaacttaggtctctagtcacctttaatcatacttgatatatttagggtgatttaaggtaagagctctgttttatttttgaccctacactctgcatcttttaacagtatccactgttcatgtacacgtggatttgttcatgggctgtccattttatgtttctttgtgtctttttagagccttacaatacctctctatcttaacaatatagctttataataaatttgaatatctgatagggcaaatctcccgaacttgctcttcttcagttatttttggtggggtgggagcagggaggagaggtgatatttttagtccttttattttctttaggaatttgaagattaattgttaagtgacacacacacatacacatacacatgtacacacacacacacacagttcacatttttatgggaattgcatttaatttatagataatttgaggaatgtgacatcatggcaatattgattattcctttccatgaatattggattgtctttatttattcaagccttcctgtattcttaattaatctttgcatcatggggaggagtgtggtgctggctgttaaccagggtggggactattgactaacatctttgctacatctggggtataatagtccactggtactggggcatcaggctaaatagatgagaacagataaagtataaaaattgggtaggtttccagagacccaaatctgtttgggttaaaggcaaatctgtagtttgagtgttcagattgccatcagtaggctggtttggcaggcagagaaggttgacatctctcgatcgggcaaaggattctatctctcaattggggttaatcgggaaacgactcaggcatagagcatcaggactctatagtcatatctcagccacagactaactggacagtatggccagaatctagtcactgaaagactggacaataggataaaacaaggtacagagagacaaagtaaaagggagtaccacctggtactgagactagaagtacagggatatcaagagaatgctactgagccagctcattcccaggcaaaggcttattatgtttcattcttcagcaccagcacaaaggctggaatatcagtggagataaacccaaaggtaggagagtcccaatcagggggaagagggaaggagtggggagccctatggttcctgacatgctttgctccctgatgaggtaatagaaagctgaagcagtatatagctgatataagaagattcaatgtagatagaaagaatatcttaaactaatgtctggataaaactatattaaattaagtattgtttgacaacagctaagaattaatgagaaaagtccttaaatatctctctctctatattttttgagtgagggtatcactctgtcatccagactggagtgcagtggtgtgatctcagtgcactgaagccttgacctccagagctcaagcagtcttcccacctcagcctcccgagtaactgggaccacaggtgtgcacttctgtgcccagctaatttttgtttacctttttgtagggatagtgtctcatggtgttgcccaaactggtcttgaactcctgagctcaagtgattttccttcttcagcctcccaaagtgctgggattatagatatgagccactgtgcctggccaagtatttacatttaaagaaatctcactttaaaagtgtttctgtgtaagtgtagagcttagaattgtgaaggctatatttatgtttgtctatttcaataaataatttatctaaagatgaatcaacagctcacttacctttttatttcagtaaactgaaaataagaagccacaagctctcaaagtacctaagacaaaatacactatttcttgagggctgatctataatcctgagtctataaaatcatagaagaagccactgggtttttaatgttaggaaactgattgggaaacatgttaagtattgatgtgtaggaaagactgaggtgtttgatgacagatgaaagtgaagaaaggctggtgaagcaggagatggaagggcacagtctggggactgtgtgtgtgtgtgtgcatgtatgtgtgtacacacgtgcgcatgtaggtggatgtcttaaaccacagcacaacctgactagaagtgtatgttgttgtagaagtaataactaggcaatgaatggtttcaaaaacatgttagaaatttaagtttccttttgaggtaatattccatagagattctaaaagaggttgctcataaatcaaattgtgaggagctccaacttaattataagaaaaaaataacacagttaaaattacccttaaagtaattagcataatttttttgttttgttgttatttaaataaagaacagaactgttgttgccctgagggaaaaatggataacaggcagtttgctcatgtggcttatactttatgtatgtgtgcatctattgtaatagtaacagataatgtcttctaatagctcatggaagaaattagtttcttttcgagcaaaatggtagccttgtggaagctgacaaaagtcatattataatgatttttggctcaataaagtaatgatagcttggaaaaagtaaaggagtacggcagcagaagaaagatgactgtaacaaaacaaattatttgaacaaaagataactgtttctttaattggattctcatggaatattggtttaaaatatgctgaccaaaggcagtatctggaagacaggaacttaggatttctgaatcatagttctcctagcttggattgaattcaattcaacaaacttttgttgagcatctactctggagccaggtggcctgagtgtggttcttggttctactattctacctctctatcagtttcctcatctataaaacagagatataatagtagtctttatcttctgtgattttttttttaggataaacagaattttaatgtatgtaaagtacttagaacactgtttgccacttttgcacacacagaaagtcaactgaattagagaccggaaactgaaaggtgcttatactgtcttagtgggagagacagataagaaacccaacaatttcagtagtattttctgataataccaataacatgtttatcaaaaggttgctatgggaacccaggaattgaagaaaaaacgaccttagggggatagttttctggaataaaattcaaaaaaggctttcaataggaaaaaaaaaatcccccaaaagctcaggaaacaaaaagtagacaaagtgagaggctggaacacattcatttgtagctttttgagcttccttccttgctggacctaacactacatctggtcaccttttagatacttggtaaaaacacgatagagatcattttaagttctgatactattttcatgtgtactctcagtcacagcatctagttgagactaatggaattagaataaccagaatagcaaactactattccaaagtgtagtgctctgtgctgttagacaaaatattgacttctgggttgagttagaacaccacgaaggagcagcacttttatgtcatggcccttcttttctactctctgtcaatttgaatgaagcagaagagaggcaagtattatccagttagaaataaaagagagggccgggcacggtggttcatgtctgcaatcccagcacgttgggaggccgaggcaggtggatcacttaagcttaggaatgcgagaccagcctgggcaatatgatgaaacaccatcactacaaaaaaatacaaaaattagccaaacatggtggtatgtgcctgtggtccagctactcgggaggctgctgtgggaggatcacttgagcctggaagggggaggttgcagtaatctgagatgactcccctgcactccaatgtgtgtgacagagtgagaccctatctcactaaataaataaatggatgaatgagagaaagacattttaaaccaatatgttaagaatcacactttaggataaccttgatattgtaataatttatgattctctaacctgtgaaaattgtaaattgttaagcaataaagagaaaatacacttgtggatatgcagaaatgtgagtttctcagtgcatgggaagcattgagagaaggaaggtgtccatccagtctgtggtcccctggtcgtccctcgcctcccctatgtatcttgtcttgcttaggttttgacctttgtcttcatgttatcctgcattgctatacaacaattggggcatcttgtggttgaagttttaaggtaaaatgaaaccatggttactccttgctgtttcattggctggccctgcagttcttcatgcttactagcccccttcctgccattgctactacaaaagccctccagacctcctttggtgggaggagacatgagaatgtttttttatctcactgacatcctactgaaatcagggaaagacagggcagtgtaaagctttcagctcattctaacctggcagacttcttcaccattgcagctgtatgctgtctacccaacactggcttacagaatccaaaatggctctcccagagggcttcagaagctgggcagaagctcctaatgtttgtggagacacccccttagtctttctgaatgttttaccatcttaccaccccatcttctgtccagccccatgctgacacacacttgtacacacttgcacacacacatacacacatacatagacaaactcacacattcccccacccctctcccccaacatacagacacaccttcaagggcccagacaatgtttaatctctagttagacactttggtccttatttcatcctagaaggcaatcaaacttatatttcttttctttgagccagggaaactgctttaatattctccttttgccatatctatgagtaactttcatataagctctcaattctacagttctgcatggtccaagcaaagtccttttggaccatcaaaacaaaaccgtttctctctcaagctcttagagaatgtgggttgcaaaacaattgcttctgcaaagctaatttttaaattgctatttggaaaattataactgaacaataatgcctttgtccttggctgtatctgtctgtctctcaaagccaaagctttcagctttgctgggtaaagcaacaagattagtaagaataaaaataaatcacataatatttcaaaaatattatcctgttaaatcttattacctagacctgagttatttcacacaagaagaatactcaatcagctacatccttaaggttgtcataacaaatcaggctgatttccacacatatttataaccggaattattagtttttcaaagatatgttacaggtgagctaacattagatgtagaagggaaacttttgatcaaagtttaaattctgattcctcttgttcacttggatgtctttacgattcatttaaactttccaaaatcttatttctaaaacaggcataacaattcactatgacaatgcagcatattgtctgtacttttggatgctttctggaaggttgtcagcagccaactaaattcattattagagacttacagtgaagggaaatggttcttgaggtgacccctgttcagtccagaaatagcagctctttatttaggtaattaccattgtgaattgctgctaatggccacgttagtggaagtctatgttgtgatgaggaccactttaacattggggtggttttgattctttctgctacttaacattcagaatgatccatagctgaagcttagttactattaaaaatctacagtgttttgccagtgggaattccaattattattgcctggtaattaaaagacctgcttgcctcagagtttttgaaagaacaaaataatacatgtgattgtttcaaacttcaactctatttgaatgttaggtggttgttattaatttttactaactctcttactgtactctttttctcccttatctagttttcctgctctcttttcaatgctttgggaaattcatcttcataaagcttgatttttaattgaagcaaatttttctcagagtcagcaccacagtgtccaaggtcatctgttgtcttagcatcttttccactgtttaatctgtgtcttaaggcttctttggttctttttggatctgtgattgtttctgttttctgaacatgggatatagttccagatacactgcttttttatactgaactacattctgcgttgcttggttttgttttactttgcttttctctagtattttttgagcttagggtttatttttatcatttataaattggtttgaaaaaagattaattcactcagtgttcaacatttgaatcaagtgacaattatgtgcaaaatacagtggtattgctgggatatggtatgagcccagaatgcccaggcttctggcttgactacaggatcagtggtgctgtcattcaccagggctgggactgctggaggtagagctgaagtggaagggagagttggggcagaatgagtggatgatggacaattgctgttagctttgcatgtgggaaagtttaaggtatccagtggctggtgtggtaccttagagaggctctcactccaagtggcagatctaggtatcattagtataaatacagtaattgaagccaagggagtgaatgaaagagaatggagatgaattctctgttgaatgatcaccagacttgccatgtttttctatagatagataccctggttggaagtttgtgtgtgtgtgtgtatgtgtgtgtgtgtgtgtgtgtgtgtgtatgtgtattgtgtgtgtgcatcccagaatagccatagtggtgtggaggtgtgtatgtcttcagtgtatttggtaggcttcctggaaactacagttttaaaaatgattgacaaccataggctggaacttcttaaccatgttaacatgaatttatagtttgtttattgtggggctgttctgtgcattgtaggatgtttagcagcattcctgatttctacctactagatgctaataagttcctcccacccaatcctcatccccagttgtggtgaccaaaaatgtctttaagcattgctaaatgttccttgggctagataatgccacctgaataagttcttctctgaatttatttacagcattttgggaggagccacattaacttttatgttccagaatgcttgaaaaacacattcatgtctgcagttatcctgactgatatttaggaagcagtttactcctccatcctggaggatcaattgagtaattttaccattaaaaaaaaaatcatttgctgcacataaaagtacagatagctgctagatgcaaattaaattttgttttactttatatgtgtatgatatataaatgaaaaggggtgaccaggacatgttgtactccaaatagtgaaatagcctgtagttatgactcagtcatttcaaaggaattgctgtcacttctttatgtgtcaaatacattttaaggcagaccatcccaaagagtactcttggggtggaggtaagagggtggagtccaagtgcggtgaacatgaattttgtaatagtgatttgaatgtaaaaagttttaaaagagctagtgcttaatatttttaaacttcatttataaattccttaaagcaaaagaatataaaagtaacttaattacctgccatggaagctaaattaacttacaccttgaaaacctcctcttaaaataactcagattttaaagagtcatttgtaaggtaagttgtggcattgttgtaagcacctgcctgtatgtgtgttgctctgaaataatgctattatttattctattatagaatgtagattctgtgaggggaagggttttgcccattttcttcacttttctttctccacctcccacacttccttcatgttacagtacacagtggtgtagagtgtgggctgggttgcagcctcagagagtagttagtatcctgttttagttggctctccttcttctctgacctctgccggcctccccaacagccactgccaccacctcacagccaatattcttgatattctggttgaggagataactgaagcctaggagtttagatcagggtggtatcacttctcacagatgaatctttacttctggcatttactcctaactctcaaaaaattgtggtattaaatattttatatgactcctagaattgtggctgtaaagtcccagcctctgtctcaatcttctgtcaaatgaaggaagaagaaaaagatgaattctagcttttgcaacatgtattcagtccacgctcagaggccaattcctaccttcccaaaccgtgatcacagcccttgattgacagaaatgggagggaaaagggagagggagagaagagaagaggtttttcatcttgaagacaggaagagtcatatctggagagctgaggaaggtgggaggcctcctctgtgtacttctgttgtcacttgattggaatgactaaggacattttgaaaccagaaactgcattttatcactgaatgcagaattgggtttaggatcatccaggcttatacaacatagggggaagatggagtgactatcctgtggtaagaatgaatccatcttataagagtccatggcacagtggatatacagcatgcttatctaagcttaattactggttccatgtatgtacttcggcaagtcacttaacctctctagtcctaaccccacatctgtgaagtccacttagggttatgaagatttaatgtaattatgatataaagtgcttagtagttatagaagcaattgctatggtttaaatggtgaataaacagattgtttattggctcaggaattatgtgataactatttaagaattgtacttctggttgtcccgggagattaggattcttgtttggcttcactactgactagatagtattaatagttaagtcatttaactttgtagaccctggtttccttttattcacaactgttgaagttgaggatctttcatttggtaagcttgggaattctattttgttttgctgtttaaaaacctaggcctcttgttgttaacaatacctctattaactaatttgagttctgactcatctgctagatctaaatagccgtgggaatgtgaagcttttcacaaataatgctatgatttttcagataagtttttgctctccatgcaaatggagcaaattacttaattgacattttacaattaggtattaaagcatcctgttcaaggttggaggacagtataaacttatttaaaatgtctagtgaacacagtctgtcacagggatatgggaaaaaggcaaaattgtattaagatattatttgtaagcaagtgctcttcatttccaagcagtctgtccctgaagggggtgtaaatcatgtgtctgttctgtgcttagaattcatcccttctgccatatgtttattgtataaaccaagaagatcatgtattatcaagagacaacttctactcccggcctaaactttcaaatattattcatactctgttctcataaaaaattattcttagggtctgaaagaccatcattttcttttaggtatttctgtttgtgtatggtatttgcagcaaccaacatcaacagctggtttgttctctcatttttcaaggtaatggtagggatttaagttattaagaatcaaatctaacacacaaaaatactttgaacatgagctgtgtacaaattttttattgagttattaacctattggacattgctgctgctgtggggactttatcacatacatttaaaaactaatataaacaaatggagaatatgagttgacacagaagaaaggctcaattttatgccaaagtaatagctagcactatagcatgcttactgtaggcattacgttgagagctttgtgtgcattatttcatttaagcatcccaactttactacttggttgggtgttattacttcatcatttttataggcgaagaagctgtctcagacaggttaagtaagttgcccatgttcacacaactagtgagcagaagtgctaggggttgaatccaagccacctgattgcaaagtctatgctgaagttgcattttaaagtaacagaaatttccttcatacaacactggacttatttttttctatcaaatgatgtggcaaattgagagatttctggagaaattcaggcccaaacaatgttatcgctcagatcattcagatcattttcaacattagcatttaatgaataagactgtgtcttgaaccaaacatatttataaaagaattagaggaaggtaacttaattctccattcactggtgtcttagttgtaaaaccacattttgtcaaggttattggtcataagttattttaatagcttttccaaacttaattttctgaagttaataaaatgctgagaaaaacttagattatgtttaaaagcattgagtgaactaaaacctaagtaaagctatttactttgcatacatatggccaccatctaagatggttacttatccttgaaaggataatgtttaaaataatatttaaaataatctaaacctaatttcttaacattgaaatttttacaaagtatagttatgtataaatctgatactatcttactacaagagatactaaatgagtaacataaatattaagcataaaagatttaattggactgttacaacctactctcacacagtttaaacaaaagtcagttaaataggttgtttgtaaagttctgtatagtctagatttctttcttcttccttctctttcttcaccccctcctcctctcagcatcataatgattatcatcatccccatcaccactgttatcataatcatcatggctatcttttacattgttttcctcacaacatctgcatcagtaatttaattgtaagcaacagaaattaaggagcagtttatttagaaagatatcttgtagtttttagtttgaggacaacctgaagaatgaggccttgtagagctgtgccaagacaggctgctaggcttaagatggggaacagatgtcagcagatattcatcacttagggctaaggtcagttggttgagctttggggcagagagaccagtctagtcctgtaacaccagcgtgccatgcagaggtaaatttttgtgtgtgcaaagacctacaaacatctgggaagtaccttagaagaggaggaaacagcagatctagagaggaaggttgcaggaagcagtagatggtcttttcaggtttcaccatttaggcaaatgagtttttggaccttgtgcacacatgctgtttaatcatgcgtcgggctttctggagagagttttatttataattcttgggctatgtatccattccttggtcaagggaatgtggtactctttgattgactctttgattgataagataacattttatcttactaggaaagcataaacttccaaaggaaaaattacgtaaaggagaagacatggatgatagggaaaaaagcaacatatcatgtcatatcactttaccatgcatagaaatcataaataaaaatatttttcctttgatatagtagtcacaggagatcttttgccccccaaagtcatagctatatttatagtgtttttctgaatattatatagttttttaatgaatcttggtaaaagaagattttttaaccataacttgtttttaatcctataggagaggataataagttttagcttttataggccactaatttttttcatggcttttgtattttaaataagttattattaaaatagaaattaaaaaaatctacagaacttgaattaagttaattaattaagcagcatttcataataaattctgtgctgaaataattatgatcattactttattacaaaataactatctagaatgttgtatcagtattagtgtttatgttttatcgaggcatgtgcaatgtgcctcaggtgtcatcaaggatgggcatcgaatcactgtttcccttttcataatcaactcccaaaaggtgaaaatttcccctctggcttcctagtatcctaatatattattaatttatttactttattattttattattatttactttatttctattttatcctgattgtatctcttaaggtacatattcttcttttttcacatgtcatagttttttaataagattgtttttgagaatttaaatgttttccctctaaattctatattatgaagtgtgattgtaatgtgagtgatttttaaagttgtctgtacactaatttttaaagataattccagcagcctgggtgcgatggctcatgcctgtaatcctagcactttgagaggccgaagcaggaggattgcttgagccctggggttcaagaccagcccaggcaacatagtgagaccccatctctacaaaaataaaaataaaaaaattaaccaggttgatgaagtccacctttggtcccatctactctgtaggttgaggctggaaaattacttgagcccaggagttcgaggttacaatgagctgtgttcacaccactgcactccaggcagactgacagagtaaaatcctgtctcttaaaaaaacacaacacaataaaacaaaaccaaaaactacaagacaaagaaggctaaggaatgccagaaatccccagaaactgagagaatcatagatgatttccctctcagagtctctgataaggaaacaactctgttgacagcttgattttggacttttggcctcctgaactgtgagagaacacatttctgttatcttcagccagatagacagacagacagacagacagataaaattatctctctgtttgtaacaaaaagatcattccccctcaaattccccaaagtgtgtgaaacaacagcttcattgttagaacaatgctttctttgggtgttttgaagaggagtgttcattgtttaaaatgagtctgattacattgtcaccacatgttatatctgctttttctatatactttagaaaatatcttctggattgtatactccttgaagacagagctgaagtcttagttgtattggttttataccttattgtacttttgctaacagtgcattgcacctccataaactgtaatatggaaaagagataagtaccataattatttatgaggactgtaatatacagattgctgttaatattttcaaaacctattagatgtaggaatgtttctactgtttttcaaaaatgagtcatcaatgaaagacttttcataattcattcctttgtttctattgatagtggcttctatttttctccgtttaagaccattttgatattaaattctcaaatacttccatttacaaaaaataaaaggacaaaaattcatcaacacctgtgaaaagaagggaaaaaaaagaaaaaaattcggatcaccgctaacagctgattactaaggaacctgctcttaccgaacagcatgcagtgggagaaactaatgtggagaaaataatcagttttccttgttatagggatcatacaaccagaaggattttaccactgtcttacaacatacagggatgcaagccatggatttgggtccatgtgtttagagaacaatggaaatttagtttcccaaattggaatttcctctggactatatcttagcctcctgagcataaagaatatacctaatataaaatgtgtttaatgtttcttattttgttactagagaaaatatgaaggacataaagatgtcagatgtactatcctagtcactaaagttctttttgaacaactgataagtcaaaaagccagcagtagaaatttgactactggttcctggtggcctgactgtaccattagcgaagtgatttgtgccctgaggctatttacctttggttatttccccccaaaggctgaaagttctacaatatgcttgtctctgaattgagaaactgttcatttctctttggatcgtcaaagtagttgcaaataataaacttaagtcaataaaatgcagagttagaaagaaaatgatccatgttatttaacttcctctcttaatgtcacatttatatgtattggcatgtttctttgtatatacacagtaatgcatcacttaacgacaggagtacattctgagaaacatgttgttaggcaattttgttgtgcaaatattacagagtgtacttacatgaatctagaacctagatagcctactatacacctaggctatatggtatagcctactgctcctagactataaacctgtgcggcatgttgctgtactgaatattgtaggcagttgtaacacaatggtaagtatttgtgtatcaaaacatatctaaacatagaaaaggtacagtcaaaatacggtttataatcttatgaggctactatggtacatgtggtccactgttgaccaaaatttagttatgggcatgactgtatatacacacacatatataaagttgtttgactaaggaaaatatccaaattcataaaatcatccatttttataaagctttttttatactttcattttttatttggaaagttaacagtctcaggtagttcttctttggttcagttgcatagcacttctctctgtgctggtgaaatctagtaactccttattaggctaagctaaatatactctggttgacatcttatgttggcttagctgtttagtcaggaggtataattgttaataatatttagccataataaatgaagttgtctcacagtatgtattttaaaaaatggcaacatatggttcaaaacagagactcctaattagacaattattgagcaacaggaaaggatgttttcaaatttgtatacttatggttgtactctaaaatctagtagtttcctgatgcagttttatagttttctatcattagttacacataccatatccacattattaagaataaatttgctcactggagttacagcttctttaatattatttatgtgagacttctttaaaaagggaagaaataataatgtttagcctttcaacaagttagtctattgagtagctgctatgcactgatgccctgaagcacagcagtgaaaaaacagtctgtcctgtcatagggcttctagtctgatattgggctgattcaccacttttggtttaaaatcctagtttctcttgtctttaatatctgtctgtctctcttcatctttctttttctgtgaatacacacatgctatgtgtgtatatgtatctatacacacacacacacacacttatattgtgtatgtgtatatatacatatatttttaattaaagatatataattcatatatattccttaaagatacatatatatatatatatatgaatatatattctaataaataatgtaacagtataagtatcttgtttgggataatacatattatgtgttaggcttcttcagagagacagaatcaaaaggagatagatagatgagaggggatttattaaggggttcgttttatgtgcttatcgaggctgagaagtcctgcgacaggctgtctgtaagctagagattctgggatgctggtagagaggctcagactaagtctaaaggcctcagaaccggagaagacaatagcgttactctgagaacccagggcgagggagtagggaggcggttctggtgtaagtcccggagtccaaagggctggagcctagagttgttgcccaaggattggagaggaaggatatatcccagcccagcaaatagacgggcacatttaccttttctccttttttccttcggactcccagcagattggatggtgcctgactgcaataaggacagatcttcaagttaacacctcaacttaactatttgacacctcaaattaaccatcacaacatatatatatatatttattataaaaatctataaatcaggacatgaattgtttatatataagaataatacatagtttaagaattttaattctgcctttaaatacgctgtactatgtatcctcagtttcccacttaatgttctggttctgtattatgtctgccatattaatttttatcatagaattttgcttctgtgttgtttaaaacaaaacaaaacacagtgattgacaaggcactgtttctgctgaaaagttcagaagcattcaaagatcactgacaggttctgttttcacctgttcctcatcagcttttcatggttcaggtgcctgaggagaaacggtcatcaagctgagtcagagattcacattttcaggggtttgaaggggcaatgggttgagacactcccctttctgtttagaaggtaccagaggaaatattcaacaaaattttgttattcttccttaaaaagcatcaaccttataaacatcttttcatcactggcctgtagttctgttgaataaaatgttctaaagcagcaaacactgggtctgatgcattgggattaaaggtaaggatcaggggagcagcccaagggggcaggatgcccagatggctctgaggctcccccaggcaccgggagagtgagtacctgccttttcccagccccaggttgctgatgtgggggctagtatctaagcagtgatcctgatgaggggagtagacaatgcaaggtgtgtacatgtattccttgatgtattatttgatgagagttagtaaaaaaaaaaaaagcatccattttagcagcactcatgcattctatcactgatgctcaagttaacaacatgaagacataaattatagttttcacctttacactataactcttggggttataattttcttccagactcccccccagttctttctttcaagctgtagttagaatgtaggtcttatgcttcaagttactgtttgctactttatttgcaaatgttttttcctcaatatgaggccattgctgtaagatgtcctggcatggggagtggtatcatattgttgtttctaaaagtggtcctgaaacagttcagtattgaaggcagtgtagatatacttaatattaatctccctacttgattttgttaaaaaacctgacctttgacattttctagattagatattggactctttgatggttgcagcttattgagaatttggagatttgtcttgaatgcctttcttcagccattcctccctccccactgtcttgctcactgatcagcagcttgctgctgctccaggccagctgcaatattatggtttcagtgtcactgatgcagtcagttgtgttccgatttcagaattacggttggcagtcccagggtaaagtgatacgctttggcatcataaagtagtaggaccggggagcaataacattgaaagctatgtcaagattccaccctcatggaggtttcctggttacatttgaggctatggtttaaaatacatgaacttcacatagtataggtaaaatgtgtgaaaagggtgcatttataaatacaaccacacatatttataggtcatacaattttatagtagatgtgagaaatggtcatttttctttgagacagatttataaatgatttcttaagttatttgggtctccaggtagccaaaagaataatgataccctaacatgtttcttttaatttattggaaataacgatgacattaatcatcatcagaactaaaggaatactgtaaagtagattcaaaaacaccaatttatatgcttaataaaaattaatttatgatgagtaaagccaaaaacccaattctgaattttatttttgaatgtagttaagatgcaccaagtgaaggtggagatgtaggtaacctctgggaccatgacagtagtgatgatgaggagataaatatccacaactccaaccccacaccatgactctatgaaaagaacttcctatcttatcctcatcatttaggtctttggattttccagcccctattttgtattggtcctgaattaaacctggttactttcatggtatcacctttattttcttcctttgctttaaaacattggttgtggcttttttacttcctcttcatacctgttgatatactggttctagacaccactctcaccgctagttgcctggcccagctgccaatactgatggccaaaataagcaatttagtaaaaactggtggtaatggtgggtgtgtgtgtgtgtgtggggtaataaaatacaatcttaccatttatcttttatgtaatgttttgagaaaactgtattttgggtaacttactaaaacttcttttagtcagtaaaactgcatctcatccattgcggatgttcttggtacaagatttctcctatgagggactacaaattattgggtctcttgaaactggaaacagactctcactcttccagtagtatataaacacactggagggctcctggtaagggccctaggagtgcttcagaagtacggtacatcaccaagtacaatatggggaagagcttcagagccatagaatcctttttcctgcatatttaaaattccaaatgccataattacccatttatgatgtcattttggaacatatagcaagactactgaatgcttaaatttacacattatcttgactagttcattgtttttctgggttttagaaacacgtggtgaagatatggctcaaatttcttttgaaccactgggtctgctttgctaaatgtaactttacaacaaaatggatgtttatactggtaaatatccacaagatatttgggaaggccggaatggaagtctgcctgattcggtgtataattttgtgggcaaagataacataacagaaagtgcatcttgatatttggaaaaaaaagatcattttgccaaagatgtttccttaaagtataggttgcaaactcttggacagaatctggcctggggagacatgttttgcttggctttcatagtattcaaaaagaataaaaaggaaatgagtttggccccctaagtcagagactgtgttctctggttgtccacaccaccttccactgcttattaccttagttattcccattacttcttgaggtcatgagatatttgtttcgtgactcttgctaaatgaaagctctttgcagtctgtgatttgtgtacctcatcctttaagttgttgtcacactgggaagatgaacctccttttcttcctttttctttttattcttggcttcttttccaattcgggcaatagcaggcctcaagtggactttgggaaaggacaaatggaaggataggaggaaagcacgtccatgctctccagcagtggtccttggctgtcagaagggatggagacaaccaggggaaagcatcctcactgccagtctgtggccaggggaggagggggaaagaaaacttgttactcaacttgccttcctgtctgcttgcttcttgtccctgtatttttcagacatttgcagctgaggccaatttatccctactcattcactcagcaaatagttttgaggtctgctgaatgtggagcatcataccctgagagtggtaggcagtaggggaagataccacgagaatacacgaatccaccactatcatgggtcttcatttcacgagtgtggttttagcttacttatgagactttcacgtttcatctgtatcctttcttacccagccttattatctccctagaattattattcttatttcttaaaggttagctcttcggttgagagtacacagtggttgcttaacactttcttctggatgttaagtagattattcttagagacctgcttttcttttgagtgatcaggataattttcagcattttttttcagtaggctctattagctttagtctatgttttgcttcctttactaatctttgaatagggcagtatcagtttgtacaggctcatttgcccataaccagaaggtggggttcgctttgattctgctctcaatttgtttgctgtgggaatctcctcaggtttccacccaaagggtagagcgtgcagttcccatcttgatctctggtgtagaagctctgctgtacaggtaaggtcttctcctgtgctgccagctttccacttgtttttctgccactgagctagggtcacacactgaagggcctgcagagattagacagatgaaacaaaattagtgaagcagtatgcaacctatggtagctgtggaagggatttaaaggcagtatttctaaagtgctttgtccttttaagtggaatttgcccatgaccaaatatggtatttgggtatttagtatgatgccctggctctaaaacagtgtttcttaaatttttctgaatttttttgaccgtggtaacacacaaacacacacgcacacacatatgactattttaaaccagaagtccagtattttacatcttttggagtcctctgagaatcaactctcagaactgagattccttatttcagggatttgaacatttagtagcttttggcaaatatattcccaaaatatttctcaaaagacttaatggcagtttacatggcctttggcaatgtaaggaagattttaactatattcctttgtcagaatttaaatttaaattactttgtgacattaatgggtgaaatgccactttgtccttacttttaaacttatttttaaaaattaatggagcaatagaacattttctttgtttagcagtggtattttctcttttataataactattttattcatagacaatatagcaaagtgatcaactttttatgatgaggtgagccaagcacaaaatcttcttggatcactccttaaaaaaataaaatactgtcattcacaacctaagctattgtaagtatatctcacttcttctggtataatagacagaaacatgttactgttatagtccttgtcaatgaaagcattgcagaataaagaattgtaaatcaaataggaatggattgttgatatttttgtgcattatgaggaaagaaaattactcagctctttccctgaacaaaaggatttaaacctagataaaaattgatttttaaatattaaattgtatttctggagaactattattattgtatcttctcactaatatcctattagcaataatgtaatttttgaccttaagatttttgtgcctctgttgtgccactgctctccattgggcgtgacagagcgagaccttgtctcaaaacaaacaaatgaataaaacacaataaatttctcctctgtattcctaccttctctattaagtaatcaatgaatatgttacggaaaaatagtactatttctgctaaagaattcttttcctgaatccatttgtcacattaataacttagatacataattaaaaccctcttatcttggttttaatgaaagcacgtaagttatatattttgtttttctctgtgccatcttagttatatacactacaaaagatatgtgtaatttttgctgaaatatcctttgagttttactccagcacttttttgagtcatacccaaaaacccaaaagattttaagccttgcccatgtattatgaactacacataatttttgcttcacaatgggccaaaaattcatttattccagcagaattggaccaagttttagaaaataggaccatttatccatggtgatacagaagtgtagcagtgtttatacttttgatcattccttagggaagcatgaccttggtagacaaccagctggcttcagggaaaattgtacccttgatacgtgcttaaaacagcagtgtaaaatgtaactggctgacaatcttggttttggttagggtcactttcttcttattcacggtatgctgggagtacaagggatgatgtcagtttctaccctttagaactgttatgatggccagacatagtatttccctctgttgtcaacacttgagaaaaatttgccaagtggggacttacgaattgaaaagcagaggatattagtaattgttgttttaagaagagaaaaattcatttttcaattttttttagaaaagaacaaaggagttgaaatttaaaattctagaaaaacttgtttctaacaaaaataaattgatttttaataccagtatcatgcctttccttgttacttatcacttaaaataatctttaaattaatttctttctttcttgggtatgctttgccctagggcattgtggcaacatatatagtacaaccctttagggacctgagttaactcgtctttgcttccccagtattagcacatgtggttcaagaaattgttttaatatgaactgatgacctttggaatttatacaacattaaaagttaattgagagattgtatgtaataaataagatgatgaaagtgatttcctggtttgtactaatataatgttcaaattttcttatttggcattatttatctcctaattactggcacaatatggagcaaagctatgaggctcagaggttttctagtgtgtaacttgtctcttttgtttctgtagcagtgaattataggtgctgttaccatgtataagttttctctaagattctggttagctgatttaccgttgaagatttttcaggagaggagtgctgtcatggataagcagtctggcagaggatgtgtgacattgatgatgtcaggaaaatttttccctgtgtctctttcagaatggaggatggtgaggaaaccagaacgtgatgctttttaagaaaagaggacatggtaaacaattgagatttgattatatatttttccatatggaatatcatattctgaaaagattttctttccaatcctcaaagggaccagtttaagaaattagatgtattaagcacctttgaaacactatatcaacaacaaaacataaaacagggggattaaaaaatggagaaaggactcaaatagacatttgtccaagaaagatatgccagtggccattaagcacctggaaattgcttaacaccactaattattagggaaatacaaatcacaatcacaatgagataccacctcgttcccattgggatggctactgtcaaaactacagaaaataagtgttggtacagatgtggagaaattgcatctcttgtgcactgttggtgggaatgtaaaatggtatagcctctgtggaaattactatgactatttctgaaaatattaaacaattatggcatgacccagcaattccacttctgggtatatatacaaaagaagtgaaagcagggactcaaacagatatttgtacacctatgctcattgcagcagtactcacagtagccagaaggtaaaaggaacttaagcatccattgatagatgaatgtataaacaaaatgtgatatatacatacagtgggatattactgtttcaaaggagggaaattttgacacatgatacagcatagatgaaccttgaaaacattatgcaacgtgaaataaggcagtcacaagatgacaaatattgtatgaacccatttatataaggttcctaaaccagtcagattcatagagacagaaagtagaatgacaccaagggcttggaagaagagggaatgaggagttattgtttaatggctacagagttttgctagggaagatagataaggactagagacggatggtcgtgatggttgtgtaataatgtgaatgtacttaatgccacagaactgtacaattaaaaatgattaaaaggggaaaacaaaactatctttatggaatttttcagtcagcttgtaattataacctgaatgctaaacttggaacaatataataggtattaacaccatggtaacaacacttgaatgaaggtaaactgctggaattaataaatgataaatatagtggaatgataatgacagtggtctttatggttggttcaggttctaaatttgccaaatactgtgcagtaactcttgaactctcacttttttatttattagaagagcataagcatatttacagtaaggctttagttatgtggtacttccaaatgcctcctgccattgccaactccaaagaaaaatcctggaagagccaggaagggtcttctaaggacagaaggtgtggaagatgcagcaccctgattgtgtctcaaaagtacaacttggctttgtagtagaccttttcaacagttttctaaaattctatgacatggaagtcaacagtattaatagccaaatcacatgttacaatttcttttcttcatagaaacagattgagttgagatggagattaggaataagtttatgaaaatgtttttaaaaactgatggaaaagagtgaagatacaaaaacaacctgacaagcagctacttcaatctttgaaatattgttttggcagaaataattatgttgctacctacaggtggttatgctttgtttgatgtttaagctgacagggaaatggggcaaaaaacttttgaaagcatttatttactatttacccatgtttaactacatctctaataaatgtcctctagtccagtacaatacctttgccgccattgtgaccttttttcagtaggaacgggaagcttgtgttcagtactaactcagtgtttgtgtatttgttaccatcatgcatgtttaaaaaggtacacagaagcatgtattgtactgcgaactcgttattctaaaacaagtctggaataggaaaaaataggtggagagagttggcccagggcagtcctctattacaattagaacgattagagcttaggttataggacttctctttcagcatcctaataacattactggtcccctctaagatatgaaagacatcagagacttccagtcttgaagagttattcatgtaaattactgtgtctgtgtgctttttggggggatcaatataagcaacatttattgagcggccacatatacaatgtattaggtattctagttaggtacagaatatttgttagttctgaattccatgctcttgaatgatttggagtgctgaaggagatagtatagagaccaccaccaccccccgcccatgaaaaaaaattcctcaaaacaaagaaacaaagatacttaggtccttttctaagctgtttatcttttactaatatacaaagggcataatttgctcaatgtaatatctatttgccatgtgctgtgttcttcagtaggcattgtaagtaagagtttctgtcttcaaacttgtaatttagagtgaggttggaggattagacatatctatacagtgctgtgctatgaggtaaattgtgtgtcttcctaagagagagagttgaagcagagtgtgctgccttcaccttattactgtacttgattcttgcccttgtaacctggttttaggtttcatataatattttgcattgtcagctccctgaaattctactgggaaatggttacgagtacatagacaatctgacaagaaaaaggaggaaaggtaccatggggtttaatataagggaaagcccagctggttgcggggaccagggagaaagagttgtatgagatgggtcttgagggagggatagaatgtctgccagtgtggggaaggaagtctgaggtggaaaaccatcaatcacattcagagttgtgaggggactgacatgcctggagcatagagggactattagaaagcaagttggaaaggtaaggtcgattaactgacaggaacatgtttatctgaaatattttgaagtagctttcagaaagatgtccacttttaattttgcaaaagcagttttcttaggttcttcagtatttcagttctgattatacaaatcattgaggaaaaaatgaaccagtgaggatgtacaaaaatttcccaaatgttttatttctttgtcaacattatttgcttatttttcagctcttcatgtaattgtctttgtgctctgcttgttcccttttgtactttttccacacgggtgataaagccctgacaatttagtttttcttggtttacactttcctacaatactaaaatatgtgtaaccccctcactaacatctttgccaaaatggagttttcaagacattctctgaagctcaggactgtttttttgttgttgtttagcattggcatttctccagcggaatactagccagtggtccagtcatgtgtggaggaggtcatgctgattaacaaattactaggcatatattaatatgtttgctaacctgtgattaattgtgaggtttttctggctaacttgttacatgcacttggctacaaaacaagaaaacgtctcaaaaaatgtatctaattcagttgcgttgatatttgaagttcatcaaaattctatccttaatgattctaaattgtataaataatatgttcttgattaatgaagtatacgtgctatgattttaccattagttgtacttatatgtatgcattacatatatgaggttctcttgatttcagaaggaactgatacagaccagctttggtgtttcttttgctttttattagctttatattcggatagaaaatattaaaagggctataaattgcctatccaaaatattgcttttttttaaccttatcagcaggcagaatagttgctgtacttggtgtaggtaaggttcagttgtctgtaagaaaacaatcttgctatagattttgaggaagaaataaaataaaaaatacagatagatgataaatgttttgcttttcaaatgtcgatgttgtactttcaggaatatggaagctttatggtttgcctatctgtatcagttctcctagaataacaacttaacagttttcctggttggattgtgttaaaatctttaaaggctatattcactaaaacatatgtctaatgtttgggcagccaaagtctgtgcaatcattttaacagagtataacttagcagctctcttattaccacaaatatcttattgttaaaactacattaaaataccatcaatttggaacatgctacttcataattaaatcattctgggatgtgatcaagtatatacttctgaactaccttaaaaatggattgtgctaagaatgcaatagcataaataaatttaaagagaacatgcataataaagttaaacgatttgttttaatggagtttttatctagttaacttttcttgagtgtctacaatgttcagagcactgtgctagacattctgcattggttaatttatggtcattcataaagacgtttgggtagaaagaaaatgggtaatggggaaaagtcatagagtggccaaacaagaaacaagtttagggttccagcagaacagggatgccttgatatatctgcctttggcaatgccgtgtgtacggagctgggattctgattgctcctattgtgatagtatgccactaatgctctgttggacggaatgactaactgaagtggtgagaaaactgcgagcctttcaggactgtttttaatgcttttttgacaaatcttttagaacaaatcttttgttcctttgcagggaacaaagtccttttgttttatggtagaggagttattcagggtcctgatcttcaattggcttagctttccctgatgccatttgtcacccgtaactcattggtgctccatctgccatagcccggaatccaggaacagtactcggtggtaaaaagttggagaagtagatacttgcaaatccagccttacgtgatctttcctggctttgataggttcagctttcatcctgaaaagttgtttaaacacttttaatttgtttcaagtgatgaaatgaatttatctcagaagaaaatttaaaaactttaaaatttattttatttggaagaaaatattttttaaatgattattagcattgtatctacaattatttatcttaaaaaggtaaatggccatctccattgaaacatactgcattaatttttactaaggacatcaaaatgctaaatatggttaggggaatttcttgacagttacatattattttgcctagatatgtgaacattaaaagcctattaaaggggacaaaaatatgtactttaatcagaatatctaattaaaatagacagaatagaaagaaataacattctcttgttttgtagatttataatgatctcattttcactatactaacattgttaataatttccaaagtagtatagaaaagcagtcttcaggaattttatcaagttaaaattgtgaatgataaaaagcatataacaaatttctactatacctcacaaaatgattgaactgttttcagacagttcagtatatgctaattgagtgtgactgaaagtatcagtcttctaaatttttgcattttcagaattttgacataatacattttaatacttttagacattggcaatgatttttaagaagcaaaaatgaatcataagtgctttccaaattaagtgaagtaattgtaaaatactcagctcagagcctagcacatagcaatttttgtgacaatcattgtttatgattgtgattgttacttctgactcctctcttcttgctgcactatttttgttccatttgtttgtagacaagtggcaatttccacaaactcaaagtgtgattacttttattgtatttttcctctagttcttggtgttttagaaatttctggaattatttccatatctgtcagcctaactcctcatctgagagcacacaatttttgtaatgcacatacagaggtgttgaagaacttgaacttgtctgatgccagtagtttattgctcattttgtcaagtatctaacggctttgagggccaagtgatgagctggatatggtcctgacctggagcagatcacacagagtgggatgggaagactggctccctgcgttgttagtgtgcctgtttgctgctggagtttggatctcaggattcctttgtttctgaagctagtcctaagatatcacaaaaacattattatgttttttgagaagattataactacaaaataacatgtatttttaaatgtttggcactaattcaagggctttccctttatttttatttattttagacttactagaatactttcagtgatctaaacatacataaagcaaaaagtaaaagtctctttcctacacttccttcactgcattgctcgggagaaactatttttgatattttggagtgaaagtttctggactgtttatacatgttggctcgatgtacatgttgaaaagataagttgcttggtgtgctcactgctgtggtggttgttttttacaaaatataagattatatcgtcctgcaacttactcattttaccagttaatttgtcatggctgtctttacatgtccttagtctttttcatggctgcataatactctactatgttgatgcatattggtctatttagtcattcctctgctgaggagtgctcagaagggctccaaattttatctgcttacaaatcatgttgaatcaacctcaaatgttggaagcttttgtccttggtcatctgtgcttgatttcaccatccactctgtggccatctgcataggctataggatacataggccacctgccctggttgcttgtttgctttcagggattattctaaaggttgtcatttgattttggataggcctgagctcagacaaaaaggaacaatttggttgtgtagggttttagggtaccagcatttttatagaagtttcttatttctacctgctcaaaatttaagatgcaccagatagcttggatggattttggctgtcatccttagatacttttatgttggccaagttctgagtttcagagctataagagtggtctgattcggaggttgcagtgagccgacatggtgccactgcactccagcctgagcaacagagtgagactccatctcaaaaaaaaacaaaaaaagaatgatctgattgtcaaatcttttttttttcattgtttattcttaaagtcaggacatcttttagaaaacactttgaaaatacatatgttgttttgtgattgtggaatatttttgtctttttatatttttgtacaggtacattgaaatttaatttgtgactcttacaaatggcataattaatcacagtcatagaaagccaaatacaaatatcctaaggttagcgtttcactggggtttgagtggtattcattaaggtgttcataaaattttatgttctaaagtcactatttacctagtagatatggtaacttatttttgtcatggctactggctatatctgagagtttaacatatgctagctgaaactgctgcatactttttaaattctgaactataattgcctagaatgaatgaaatcttttatttcaatagatatttttgcttgaaagatttcattttatatttatgaaatagtaacagattttattaaaggtgatgttaaattgttagaaatctaaagacaaaactgccatttctctttggtactatgataatttttcaacatattttaagcaataacctgctgttgattttaatagttttacctgccaacacagctggcatcctgctatgatatcattgctatacttttttatttaatattttacagagtgtatcatgcacagtgtggacaaccacattgaacaactattgagaatacgtactcattgtttgtgacattttacccttaaaatagagtgtggtcatcaaccagattttagagcacattaacgaaggaggtttacttttgcagggatttcttactgccaaatttttcctttgctatagctttcacatactgtttttgtgttttccttttccataaaacagtatttcttaaggccattgttatttatgtgcaaacaaatgaataaaaaaaactttcgctctttaacatgaagaaaaatattaacattgaaatatgaaatacagcaattcagtttataacacaaacgtatcttacaataatgggtatgcatttttaattgcatatatggaattacaaatctcatttttcttttctactgggattacaaaccatattgaaaaaaattttacagttcaaaaatcagatgactgacctgtcgaaagcgagttgtaacttattggcatacaattgaattactgatttttacactatttattgaatgtatataatttacttttattactgatttaaaactaccatcatatatataaaatagatattctttttaacatcaggtttttcttttctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccacatgccaattccagaagaaaataaattacttatcacaatatgtgaaagcatacactttatggaaatgtagtgcatgctttcatatactgtgataagtaaattttttttcattttttattctgaccacactttctgtttgttagttaatgatctaattaattttctagaacagatatcttaaaatattgaaagctgaaaaattttttatgggaagaaagtttggaatgagtctactaaattaactttgcttgtatttgctacgttaacagaaagaaaaatctttttaatttgaatctgttcccattccctgtttatatgacttgaggttatggaattggttgattgtggaattgatcttagattttcacagcattcacgttctaaaaatgaatctctcaaaagtcaataatttaaatttaataagtaattttgaaaattatttattttagttattcaaattatgctatggtattggaaatgctttagaattgtttaaaaacctatgtttttttaaaaaaaatgctcattaagatgccacatatcaggaaaaaattttatacacctctttctggcaagttttacctaaaacctgtattcaaatttatatcatagacatatataagataatttaaggtagtttcattcttcctaatttttaaattgaaaattaagtagccatattttaaatggaaggtgcatgtcttttaaattcagaatatcttcgcagtttgcaaacactttacttctctttactggtgtgaagatgctttaattgttaaaatatatgaatagggaattcctttaagagtatatggcttactacattgttatagaattatgatatatggataatggtaagtttttatttttagatgtttaattagtaaacaatgatttttaccaatgaaatatcttaagtgctaattgcaaaattaaaatatttgtaaattagatgaacccaatttaaacataaatgttttaaaaactagatcaaagtaatccataattatagtcaaaaacgaaattatttttacaatttatatgtagtcactgatagtaagaaaagcaaatatttgagttttgtagatttattgttttcctagttactatatcaattaaaatttaaaatgtactgattattattatataacatgagtacctagtatttattgtgtattttatacattgagtagcataatacaaagattagggcaatcatttcaagccagaggcaaaactggaaaaagaaactggattttctgacttatagttaatatatagtctactaaaccatttgaaaggatagtgactgttgctaattgaaactttgacagccttgttgtgttttgttcactgcttattgatatctcaaaagtttcaattgcatataattaaaaaaggaaaacaagtagaacatagttggaattagatactataactcctcttgtgaagtttgctttctgtaagtgtgcttttaaagtttgatctctgtaagttattggtagactgcaatttaatacaacatttttttagattggaatagaattagaaagataatctaatccagtgtctcttggtcttaaataatatgtggtcttatgttaatggaaaaatgtctctcaggccccaagaatacattagtgaatcctagtttgagaagtagtatattaagaattaaacatagtcactataactaacataaaatatcataaacataatatcaaaataagatcctgaaattatgtgataattgtcagttgcaaaaattgtcaatgagagtatcagaatataatcgtatttatataataatatgaagacaccaaaacaaagcatcttgtagcactctcagactcccaggaatgtgttcatagatcctcaggtgtccctagtctatattttgagaaatattgatctaaaccaactgcattctttttacagatgagtgtcatccagagtgtttgtgacttacccattttataaagacagtggaatatctgggattagacaggagtcttgaataaatgtaaagtgtgtgcacatgcactcttaattcaaaatcccctgccttccacgaggaagataatagaagttttggacccgttatacaatgttctgttgttcatggcaaaattattcaccagctaaccacagaatgacttgagacaatagtgtaatatttgatggaggaattatatttaatattttggataatttgagtttggatttattaatatgagaaatttgaaaggtacacagtgtttttgcttaattcagattttatttgcacaaatagaaagtatagaaaatgaattttagtaaaatttagtgagcatgatatccataaatgtttgcctgttatggcttttatctactgataaagaagattagaaaaaaaactagacacttgaaaaattttttttcattgataattttcccatataattttgagtaatctgagtaataaaatatacctttcagtaactctttcatgcagatattcaactatgcaatatcctgtattgagcttcctctctatggaaagccttgttccatattataagtgaaacctgtatcaaattaccagtgccttgggttgtttaaactgagatcacctaagtttgaggtacaactgctttcaccacttagcatgattcatatttctctatttcttttttggggtatattttttaaggttaaaaaagataaaacagggttaagatattgaaagccaactttctgggacagcagagaaaatgtacacggacaactctttcattgttatctgggaaaagatgttttaaatcgtggatgagaatgatgtataaatttgagtacttttgattaaaatatgaagttattgttggttcaacaaatgcaagttttatgtcaaaggaaatgaaaacaatgtttgctccacaggcgatttttgatagaagatatctggtagctttttaaaagctcatggttaatcctacaaaattgcttttaaaatattttaagagaatgagtattaatagtaaagttattgtttttaaatacattaaaatctgaaaacacctgaaaatatgaactatgctgttttattcaaaagtttaagttactacctatattaaaataaaaaatattgaagagaatacagcactatggagagtattcttttaagtttataattggtatttttagatagaaaaattatgctatataaaattaaatatcaaataaaggaacatttttataagaagtggtattggcattactatttaaagcttattttagtatacagatcaaatatgaaagaaatgaatataagatggagtcataatttatttacaaaactctagtttatagcagatggctctttcatcgtgcaaggaattcagtgcccacatcttaggtttgtttcattcctgctacttttttttttataagcctatttattttaccattttacagaaatttattgttaacagtcttagtttgaaataatggtaaactcacagaagtgattagaagactattttatattgattagacataatttttaaacttatttatttaaagtttcttcataaaacatatatatagagagaaataaatgattacaaaaataaaaaacagtgcatctaatttacgaagtgctttatatttctattggatttaatttggaaattaactggaaggcagagcaagctgaggtctggtatatttggccccactctggggaagatttcttggtcagttatttaaagcttcactctctcttcttatcttacattcccatctgttctcactttagggtatgggaactttttcattcttttcttttacttgacacatactataacttaaaatgcttcttttagggagtcatgaattgtgcaccgtaatttgtggaaaagtgcaatgactatagagtttagataattcattgttctttttattgtgtattttaagcaaagattttattgtttcagaaaattatatgaatgaattttatttgatgcttgtatgcttcagctttatgtaaccccaggtttttttaagaaagcctttagtgtgtaaaagtgttaacctcatctattttaatatcacccaaattaatttatatattctagaatgtaatgttcaacatagctattatttatttaaatattaagaccaaatagtttatggtattttggctggtttaaatagagtaaatttttttaaggattgtaaatcagcctttattattaatttccaacacacctgcataatgaaaaaacaaatcctgagtctgataagagttgtgtgataattttttttaaagttattgtttatttctcctgctttggattcagtgcttaaaaagagtgccagaaattttagggatgtggttggcttaagatttgagttttttttttttttttttaaatcacatggaagcaataagtctgcaataaagagtccaattggagaggatggtaagtttccataccattgttacatcctttctgtgcggtctcttttcttagcataagaactcagaaactgtggataccaacatatattttttaagattatcagattctaatagttcaaaggatttttatagggcctatacaagtcattatgtaaaagaaaacttttaataactttcaagttaaaggaatttttgcttttttcagtgtttcatgttagaatagtttatggagaaggattttttcttataaacttattactactaaatttccaagcactttgtttaaagatatcaatctgaaaagaggggaaaagatcctatagggtcttgaatttttaccattctggaaaacatgtttcattaaaattgccgtgctggtaaattgtcatcagagaaaactatcagattagtaatttgatgagtagtttactgcaattttataatctcagttaacaaaaaatttaccagtgatacaaaacctttcctaatagcaacagataaaacaatcaggagaagtatacttctgtactaaaagatggagccagagcatcagaaaaacagtttaatgtggagtgtttggatataggatggcattttaaaactgtagtttcttcctgaagcctgtttagtattctgtaaacagcttctgtgaccacagataggaaccaaagtctaaatcactctggggatatattgtggattgggctgcttcattactgtttgtagttaaatccatgttatactctgttggttcttctccttgccctaaccacacctggtctgcttccatgtcatcttctcctttgcttgtttagtttccacctccaaccctttccccattcttttttttgagagggagtctcgctctgtcgcccaggctggagtgcagtggcgcaatctcagctcactgcaacctccgcctgccgggttcaagcaattccctgcctcagcctcctgagtagctgggattacaggcacctgccaccctgcccagctaatgtttgtatttttagtaggcacgaggtttcaccatcttggccaggctggtcttgaactcctgaccttgtgatccaccgacctcggcctcccaaagtgcctttccccattctttcctgggacgtctcaaccatttgcatggttactcttgaaaccttcaaatttgaaactttcaaggtttgacctgttgagctttagacccaaaattccaacattatgcttattttggtagagataaaacatttgtgtaataaaatgattatctggaaaaatttgaatgtgaaacaatgagaaaaggtaggcatatgcacatggttatttgctagtttatggaaatcagcttatataaaaatgaactctatttctcttcaactttttctggaccttttaaactgtctcctttttgtttgtttgtttgttttttgttttgttttgtttttttgagacagagtcttgctctggctccatcacccaggctggagtgcagtggtgcgatctcggctcactgcaacctctgcctcccgggttcaagtgattctcctgcctcagcctcccaagtagctgtaattacaggtacctgctgccacgcccatctaattttttgtatttctagtagagacaggggtttcaccatgttggtcaggctggtctcgaactcctgacctcaagtgatcctcctgcctcttccttccaaagtgctgggattacaggcgtgagccgccagacccatcctaaactgtctccttatctttgtctccagctgttcacctctcgtctaattactatgtattattttcttaaaacacacatcaaatttcgtccattgtctgtttgaaagcatccaatggatcctcattgggtctagcaaaaaaatctttatgtcggcattcaagatcctgatctactcaaaccagtcttccagtgttatttctcacatccctttttgactccagtatgcagatcacactggcctactggctatttcctgaatgataagtatttcttataaccatcctttattaagtattctggggatagccttaatatgggcatttcatccaagaattggtgtccttgttttagagacacttagagtttattagaagtcgatgataaacaggtagttatagtacatgttagaatggaatattcagagaactataggattataaaatacgtgctcatttaacccatatgtggcagctaagttaactcatgaaggataagtatgaacttggtagtgaaggtaggtgggtatttcaggcagaatgaactatatgaataaggaattaggcaaaggatttgctattgaaggaattaaagtggttttgtgtgtttaaagactagcatgtgaggctgtagcgtaaggtaagcgttgacaagtaggtaagaattagatcctgaagaatcttaaatattaaggaatttgtttttatgtggaggaaatagatatgacagagtaaagccagctcacatagatgtaacttccagttttctcatgtaatatatataaaatatactttatggagttcttggcaaatagaaagtagtaggagctgaaaatattactataattatttaaggcaaaagaatataagtgaagaattttaagcaggagattaatatagatttaaaagttagaaaaactcctaggtagttgtgtagaggatacactggggaggagtgagagaggaagtgatggagaattgctaaaaagctagtcacagactgcaaaacaacattttggtcaacaatggaccacatagaagatgttggtcccatgagatcatagtggagcataaatagaaacctaataatatggtgcttgatgtgggcattgcagatcaagtatgggaaatgattgatatttaatgctgcttctgggatatttggttttccatgtgaaaaaatatgtatataaataaaaatatatatcatctaggtttgtgaaagtatagtctgtgatgtttgcacaaccacaaaattgcttaatgcgtttctcaaaatgtattcctgtccttgtgactcattactgtatgtgattaaactaggtgagatttgacggtcttctaaaccaaggacatgggagtaggttagagaaaggtgaatttttcagatagtaggagagagaatctgaatgaaagacttgctgactcacaggagtggggtggggattgaagtggatgagggagaggcagacagaagtcaagaataaagcatagcttggtttctaggttggatgatttttgaatagaggtgcagtttcactgagatggggaatatcattgaagaacaggtgtatgcgtgtgtgtgtgtgtgtgtgtgtataaggtaatgagtacattttagatttgtatctgaaatggggatgaaaatgtgtttctggagctcaggagagaatctaaggtgtaggaaatgggtaaggattcattctcttatactgatatactggtggctgagttcatgggtatagatagggtcacataggaagagataatcttaagaagggaaagtttctgaagaagaagctgcctgggttgaagaagaagccacaccaacatttaagagaaagaaaggaagttatgaagcagagtgagagggagtggcttcagaaaaggaagggagtaggagagagccattacatgagacaagtgcagaagagtttgacaatagcatatatggccaagaatattaaatgcttccagaatttaagacagctaaagactaatggtcctaccttgcatgtagcaactggaagacactggtgactgatgaaaacagaagggtggccaggaagccagacaacatttagactggtgagtgagtaagtagtgaagacttgaaccgatgaatatagactaccatttcaagaaacttgactttcaaggaaaggagaggaatgaagtagttagagctaggtttgatctcttaatgctattcacttggcatagaatgccatttatttcctcaatttgcagtcctccctggcagcctgcctgtcttctccctctcctccctgcccctctccctgtcctcattctctcccttcccctccaaaccatctagcagtcggtttttaaacatctatcaaacctgacctcttttttccattttcctaataaactctaaatgaacttagaaaaaaaaaagaaaaccactaaatctaaaaggaaaaggtagaaaatagcttatattgggatgggcaagacatttttaatcagaaaattaaaaggcagcagactcaatcatactgttacagagaaatatatttgcataaaatggaaatttttgtatggcaaaaacaagcatgattttaaaaacaatgacaaatgagaatatgttgtaacacatgacagagaactaacgtgtactctgttaagcattcttaaatgtcaatacggaaattaatagggcctttatttaaagggtcagaaacagattagttttataactatagccagcaaacatgaaaaaatatgccacttactattgataaaatgctaattttaaaaatgtaatatcgtttgttacttataagagtgggactgcttaaaaatgaattttattttctgctgagatgatgtagaatgtgaatgtattaatagaaattgattcacgtttccaggatatcatattgagaatgtgtatcgagactcttcaaagtgtagatttcctttgattcaagaattctaggaatcctcacttaggagttaaacacaaaaatatgtattcatctcagtgttgttcgttcgataggaaaatatcggacacattattaatgacaacaacaggaatatattttaataagttatgatttgtccacttgatgaatgttatggatttatcaaaatcattaaaagagtagttgataacattgtaatatttgcatgaataaaatagtaaatgaaaactcacctgtatgcaaacctacaggtactttacttgctcaatgttgtgaaaagaaaaaagaaaaaaactttatatatacatacatctaggcataggaaaagaaacttgcactataagtcttttattgatttgtattttctaattgtttcttcatttttatgtacatacatgtcacttttttaataattaaaagctttattatatgtagatgtttctctcacatgacatggttattcttttaaatcttcctagttgttttaaattaaaaaacccattttgcttataaagttgttttgcaaagatttcatattacttattttgacataattcctttatcatgtacatttgagttttgggatttaccattcatagtgatggtggttacttactcagaattgtcatgtgggatgattttaaaaccaatgccacctcaccgcataagatttggtttttctgcaggttagtgtctgtcttctacatgtatggcatattttgattcattgctcttattacagaagtgaaagcagcattgtattggggtattcagattatttaatttttctgtattaatcagtaatgatactgaaactgacattactagcatgtaattgatactaacattgggttcactgcttattttccatccctctttttggtattgaatttatcatgaattgtcatcattctttttgaagtctttctggatttaagccagtcagaaaaaagatcatatttcatctccctgagtaataagtgccccagtttctctcatgcaattcttggtatttctgtagtcataagtagtcccccttgaattcaaaggtgcattcataccaagctcctctactctttctctgttgtcaccccagtaagctaaggaagacatttatatttacatatttaccaatgaagtttcgtagactgaatggactattaattagtaaaatagattctctgaaggaaagcattactttatttaaaaagttaatggtgatttctatgacttggtccctttttgttgttttttaataccttaaaagttgtagtttccattcattgcattgatccttgaaaatatggctgtatcttcaaagaaaattatagtggatttaaaatattttcttatttggtatgaaatgattgtatttcagtatgtatattttaaaatgtacagccttatcttcaaaattttctaactacaataaggttatttaaaattttatacatgaaagacagcagataatgtatccataacctggctgattctcttggccaccttgtacaacattttaggcaaaaatgaagacacatattcaatttgccaagaaatgttagccatgttttgtcagcattgtattcacaatcagtaacaggatgggtctgcctcctggagacagaactaaatttctcattttgtcatgccctttgtaggcaataatgttggtgatgttgatagctcattttggtttggtaatttagggtaattaaacttacagatcaactcagtttgtgttttgttatgagggccattatctattttcatgaatgagttcacagctcactaaaatatagtcgagtttaaaatagacattaaaatagagattcactactgctgatgcattttctcctcaatttgaagttaaacacttgtgaaaattaagacaagttaaaatcagcacttactgcaaaaacaagaatttgaaaatgaaggttaaaagcagaaatcatctagttgataattgttttgatttttcaaatctatcaatattaatgtgagtctttaagatatctgaaaatttccatttgattggaaaatgttggatgtttgatcattttctttcaagttaacttaaaaagtgactttatttttgcttcttgattcatttgaagagacataacttttttgttttaatcctttagaggatcagataatgacatttgctgtttaagacagtttatatttcagatggcacaaagagtctatttgtctttatcaaaattattagctgaaaaggatataattcatgactgttctttaaaggggatctaaatatttatgtttttaaaaatgccttaaggtgactaacatttctaaacctatatttgtatcatccacatttgtaattgtgccattgcttaaaacaagtcctcattgtgtcctgtcttttgacaggattagtttgctctcttaattgtaacacattttcatttcttttctggattgatttaaattctgggcttcaaaaagcagtagcataaaatagtcaccatgcctgtattattagctgctttcagaaccactcagacaatgttttctctgagatggcttgtatttttaagtgttgcatttttcttcttgttctgctagtcttttttctaatagcaatggttaactctaatttatattagcagttaaaaaaactgaaacttaatcttgccttttcagctcattactgaagaatctcctgcctctgcactctgacacaaaatttatactttattttttaaccatgaacttttctgggcatagagttctacctaagtgtacatagctgaacaacttgagtgtattttgtgagtaatattccaacatcgcacaattctaaattttattaaaaccagcttttctgtggcagtcccaatacacagttcaagtacattaaaataatgaagtactgcataaatgttgataaaatagtcttctaatatgatggaatgcctaattatgtattctgttatcaatttacctaataaattaaatgcagtttcaattttaataaaacccgtgtactttataaaaataggacctttactaacctatatctatactgagtcatgggagcaacagtagcatgggtaaatccttctggtagtaagcatggatactcttatatctgttcagagaaccacagtatcttttctcctttctgcctgccctcttgctgctctttctgcctttaaaaaacaaacaaacaaacaactttccgggcagtgtcctccatgccagtcttgtgaacatgtggacctttgcagcaaaactataatattttttgtcaccatgggtaaactaagcattattttgggtagtttgtgcttatgaaggctttctccatcctagtagactaaaatagaagtatcctgtaatattagatgaaagtaagggaatgaggtttgatgtaggcaaatctttttttcctcccttggggttgatcaaagatgatactcattaaaaatactatgaaattgcttaataccattcgaaaagcatttgtaaagtggatcttctgtcagtataagggataagtgtgtctctgtgtgtgtgtgtatatgtgtgtgtgtagtaagagatgttgattctccctacattaacttttcaacctgaagaatatatgaattaactttttaaattgatacttttttaaacagtgtaattaaatgaggtgtgatatatgaattttctgcttatgctgttaattttctccaaggatatcatagctaactgtagctttactgttgctactagaagatatttgggcgatcagcacaatacataattaagaaagagattcttcaaatataaactaaggaaaaaaacaagtgggaattaggaaaaacatttaaaaacaatttctccttagagtaaacccaattttaatttttctttttagaacaaatgtcttattttgaaatgctggttaggctatttgaagagatttgctaagtacttaaacattcatttgtatgacttttcttactacttgccttgttactcaaaattgggacaaaatattttgtttattgatgaagacacatttagttaataatataaagcagcattatctttaacatcaacttcacattatatgttaaaagatttctttagaaccagaggcttggctcactgactaccagctattgaattattttccttagggacaaactcttagccttaagttaatgtcttctgagagggtagaattccttattatacacatatggataattgctttgagttaacggggaggatagatgggcttctcaggtactggttcattgaaagttttttgcctttcaactatgaaaccagcagtacagcatttttaaattgataagtgtttcatagacagagtctgaagccctgtgttattaatgaaggttttcattagtaaaagtttatttttttgtgtcacagaagtagagtatgattacttatatttatctttttatgacatatacaaggcaagcatttaagggtgattttattacatttgcattgttgttcatcagtctttggtcatctgtctatcaagtagagctggcatctatattacaataattttctttcaaaaagaaatgttcagaaatatacagtaagtgaccatagtttcagcttctatgtcaggccaaagggaggtgaactggtggggagtgagtagattagacccacttgttgttgatccaactgttaaaaacattgttctctttcccaccaagttcctaaattcttatttacttgcctaaacaggaagcttgcatagagtcagagagatcccaagctggtaatggaataatgatgaccatatactttgtcttctgtagtgggacaacagacataaagtgaggttgtttgatgtaaaccaggatgttcacttacatagttttcatgctacttaatgggaatatgtcagccaccatagtatgcaattaaaatttaagagattagtgataatggagttaggactatatagcaatttttctaaatcaaatttaggcctcttaatgtctgagaactttaaaaaagatcaagaatataaatgctattccttggttcagtgatttttttttttaatgtaatgttgatacaggatttttgctcttttagctcagctaggtccaggttcttgtctcccaaccaggaaaaattaggcgtgcagacaccagagagtgagtggaacagaatttattaagcaaaaggaaagttctcagcaaagagatgggtcctgtaaagcaggttcctggttgttcccttccagttttgaatacaagggcttttatataaaagcttgatggagctggattccctgtttgtataaggtgggaattcctggtggctccaccccattccccctggacgcatgtgggcacttagtctgctgagggcatgtttagacaagccccctgtgcacgttcccttatctgcacaaaacatgggtcagaggtttgcctgggacccttcccttactttctgcctaaagcaagctggttaactcctttcaatgtcaaagaaaaatttgaggtttctttgccagtagctactgcttcttgttcacttctataatttattcttagttagtgacaaactactcgagaatcattgaatgacttacaatttgttgtgttggaaattaaataatcctcagtagttcgataatatcaatgattcctaaataacttaaaagctttttttttccaaattgggtgttagtagttagtattacgcacaaaatgaagataaaatataattatatgatttagtatgccttttactttttagctgctcgagtaagtgaaaaaatgatcctttctattaataacaacttttaaagttttacaagcatggtgttttcaaataattgctaaaggggcaaattacactgttatttaatagtgaattaaggatctagggagaattgttaagcatttattatttcagtaaacttcactttcattaaatcatattgttaaaggcctgaaattctataaaaatttgtttaatggcatactgacatgttgttattcatcaaccttagggtctacgtttttgaaaaatatgatgagaaaagcccatttggcaagatcaggatctcatagaaaacagggatttagaagcaaataaatatgacattaaatatacttgaaatgtatatttaaaataaggacatgacttcctaaagaaactggaataatgagtatttgccaactgtgtagatacccctcccctgagtgatcttctgttcataaaataatgctgcaatatgtgattgcctaagccgactgtactttgtcttaaggtttttaaactaacttgtattataattaaagttagtcatatatgtatatataaatatataccatatatatgtgtatttttttttcttaaatactgtgaaaatgcccagccttttcagatattactctgagagttaagggttgattttcattgcctggtctttgttcatgtgtggaatggctgagtaagtaacacatagtattgggaagcttaggggcagggatggaggggtagggagcattaatggttaagtgagcattttgtttaaggggacagagcatatctgtgtgtatataaatagatgtcacattttaaaattctagtaaacacagagctgttttctcaaaacatagatttgctaagccctcattgagggattattgaatggccaattcatgtatatctagaacttactcatatatttccttgctttttgtgaggaaagagtagttcttctaattgttctttttatggttctggtaaggcattttagacagtatggttgcatataaaatttcattgcagaatctaaaatgcgagctaaaaatagccattttaaaattgattccatgagtactttacgggttatacatagtacattgttgaacttctcccttctttgaaatagtgagactgccaagtatatcaggagatgaagtgattatcaaactgcactgattaatagcaaaaagatcaaaggagacataaggttaagatggctgactagatgcagccaggaagtgcagctcccactgagagagaccaaattttagagtaaaccactgtaatctgggcagatcttcggagagaaaatgctcagattgggttgagaggcaatgttaaaatgaagggtgaagagtaaggaagctggcagccctgtgctgggtacctgaataccagggctagttcccagccccgaatggctcttgggaaaggggtgaatgaggaactgagggaaagctcactctcaccgccagcctctgggatcctagatcctagttacagaactccgtgtctcccctggatgtgtgagctgacaggggcatctccctggggagcaggcagagacaggccgttggacagcatggagcccaaaagttttcgtgcactggggagctccagcagagagcagccatagagctgctctgtggggagggctcttcatccctttctgggaggtgtggaccccagctgaccttcaagctaggagagagtgaaaccagcttccctgtgggactagagcacatctattctgcaaggcttcctgcctgctggccccacccagggtcacgcttagccaccctgtaggagtgagtgcacagcacagcccctgcagcacagcctgagtatgttgctctacctgagtactttcctagtgacttggaagcacattggatcctcccagtacagctggaatgccaacctaatccacaggctgtcccagtgcccccagggctgcttcatgcagcattttgggagtaagtagccaagatctgtggccagcactcaagtcaggtagaagggggcaagatcttcaggttactgggctggggtgggaggggagcagggtatgcctacctccacagagttgatccagagatagtgaggcatatcttcctcctgcagcccctgatcaagaaggccccagagcctgaaacacctaacaaaagaaacatgggcacagcatcagtgactggaaggaggctcccccaaggcccaggagcagacctggtgagggggccatgtctctcccccgcccactgcggagcatgcctgggaacatgaggaagaacgaaagagcctcatggtggggtattaacttacctaattaatggccattactcctaagcaccatctaatggattgcattgagactacagcaccaaaaatttatcccactactatatgctcctttgaaatccagcacaagaatttgttaccagaaagtggtcccaattcagaccccaagagagggtttttggatctcttgcaagaaagaattcaagatgagtccataaattgaaaaagcaagtttattaagaaagtaaaggaataaaagaataaaagaatggctactccatagacagagcagccccaagggctggtggttgcccatttttatagttatttcttgattatatgctaaacaagggatggattatttatgcctcccctttttagaacacataggggtaacttgttgacattgtatggcacttgtaaactgtcatggtgctggtgagagtgtagcagtcaggatgacctgaggtcactctcattgccatcttggttttggtgggtcttagccagcttctttactgcagcctgtataatcagcaaggtctttataatctgtaccttgtgccaacctcctatctcatcctgtgaattggaatgcctaactgtctgggaatgcagtccagtaggtctcagccttattttacccagcctttattcaagatggagttgctctggttcaaacgcctttgacatttctcccctcccttaaaagaacccttaatcttaagggttacagagggatgaagatcaatcttctgtaacttcttgatgctgaaaagaagcgatgacattcctctctaattgtcagggtgtcttgcattcagggtagagaggagctcagtcagaaatcatcggtatgtcaagggccatttataattcttgagttctgacagaatgtgatatctggaatattaataagtatttaagaaaacattcagtaagactattctgcattcctgcacaaagagtacaacagcaatatatttcacaatggtaaagcaagatcagcaaaattatcccaagtaaactaaataagaaggttttccatgaactcggcaactgctggaaccaagctgatatggggttactagctgattccactatgtgtccagaattagaatattgatctaatttctacattatccatcccttttgtttttttttctgagtagcagccagagatcactggttggttcacaggagtaagcagggttagtctaaattgtaggaaaaacctcaaaaataactgatgagactagaatttaataacaagtgtaccacagttcttgaaacataatttttttcgtctcttcagttttatatttttactaaagacatagtggtaagaccaagttgttttattatacttggcctatttgtataaagtgcagcaagaataattatttttcacataagctgtttttaaattggctttgatggaactctgttccatgaaaggaatcttagataagacttcttaaaagctgagccctgccatgggtttgtaccctcaaggacctaggagttgggtaaattcccctccttttatggtctgaagataacttggggctcctgggcctgtcatacagtgacattttgttacttaccacaggtcaggaaccctgtacaggaactgtgtagacaaggtatgaggccagttttcccaagggtcttttattggctctataagttaagtttgattcctcaaaggaaagcacaccatttcagttaaagccttggtgtattagtctattctcacactgctgataaagacatacctgatattgggtaatttataaaggaaaggggtttagttgactcacagttccacatggctggagagacctcacaatcatgatggaagagcaggggaggtcttacaaggcagcaagcaaaagagaacatgtgtagggaaactcctctttataaaaccatcagatcgcgtgagacttattcactgtcacgtgaacagcctggggaagacccatccccatgattcagttacctcccaccgggtccctcccatgacgtgggaattatggaacctacaattcaagatgagatttgagtgggggcacagccaaaccatatcattccaccccagcccctcccaaataccatgtcctcacatttcaaaaccaatcatcccttcccagcagccccccaaagtcttaactcatttcagcattaactaaaaagtccacagtccaaagtctcatccaagacaaggcaagtcccttacacctgtgagcctgtaaaatcaaaagcaagttagttacttcctagatacagtggagctacaggcattgagtaaatacactcgttccaaacagaagttggccaaaacagaagggctacaatgcccatacaagactgaaatctagcgaggcagtcaaatcttaaagctccaaaatgatcttctttgactccatgtctcacatccaggtcaggctaatgcaagaggtgggttcccatggtcttgggcagagctgcccctgtggctttgcagggtacagcccctctcctggccactttctcaggctggcattgagtgtctgtggcttttccaggtgcacagtggaagctgtcagtatatctaccattttggggtcgagaggacggtggccctcttcgcacgctccactagggagcaccccagtggggactctgtatggggactcccatgttacattttccttccacactgacctagcacagtttctcccggagggttctacctctgcagcacacctctgcctggacatccagatatttccacacatcctctgaaatctaagcctaggttcccaaactgcaattcttgatgtttctgcacctgcaggcttaacactacgtggaagctgccatggcttgaggcttgcaccctctaaagccacagcccaagctgtgccttggccccttttagccacagctggagtggctagaatgcagggcatcaagtccctagactgcacacagcaggggctggcctggcccaggaaaccattttttgctcctaggcctctaggcctgtgatggaaggggccaccgtgaaggtctctgacatgccctggagacattttcccattgtcttggtggttaacattgggctccttattattcaaatttctgcagctggcttgaatttctccccaggaaatgggtttttcttttctattgcattgtcagtctgcaaattttccaaacttttatgctctgtttcccttttaaaactgaatgcttttaacagcacccaagtcacctcttgaatgctttgctgcttagaaatttcttccaccagataccctaaatcatctccctcatgttcaaaattccacaaatctctagggcaggagcaaaataccaccagtctccttgtataacaagagtaacgtttacaccatttcccaacaagttcttcatctctatctgagaccacctcagcctggaccttattgtccatatcactatccgcattttggtcaaagccattcaacaagtctctaggaagtttcaaactttcccacattttcctgtcttcttctgagccctccaaactgttccaacctctgcctattacccaattccaaagtcagttccacattttcacatagcatctcactttactggtgttacaggaagtcagggaccccgaatggagggaccggctggagctgcggcagaggaacataaattgtgaagatttcatggacatttatcggttctcaaataatacttttataatttcttatgcctatctttactttaatctcttaatcctgttatcttcataagctgaggatatacttcacctcaggaccatggtgataattgtgttaactgtacaaattgattgtaaaacatgtgtttgaacaatatgaaatcagtgcaccttgaaaaagaacagaataacagtgacttttagggaacaagggaagacaaccgttaggtctgaccgcctgtggggttggacaaaaagagccatatttttcttcttgcagagagcctataaaccgatgtgcaagtaggagacatatcgctaaattattttcctagcaaggaatatttatatcaatgccctgggaaaggaatgcattcctgggggaggtctataaacgaccactctgggagtgtctgtcttatgtgcttgagataaggactgagatacaccctggtctcctgcagtaccctcagacttattagggtggggaagaactccgctctggtaaatttgtggtcagaccggttctctgctctcaaaccctgttttctgttgtttaagatgtttatcaagacaacacatgcatcactgaacatagacccttatcagtagttctccttttgccctttggcttgtgacctttattggacccttatcagtggttctgctttttccttttgtcctgttccctcagaagcatgtgatctttgttctgctttttgccttttaaagcctgtgatctttgtacctactcccagttttacaccccctccccttttgaaacccttaataaaacacttgctggtttgaggctcaggtgggcatcacagtcctaccgatatgtgatgtcacccccagcagcccagctgtaaaattcctctctttatactgtctctctttatttctcagctggccagaacttatggaaaatagaaagaactacattgatatattgggggtgggttccctcgatatactggtatcaatttactgtattagtgtgttctcatacttccgataaagacatacctgaaactgggtaatttataaggataaaggatataatggacttacacttccacatggctggggaggcctcataatcatggcagaagacaaaggaggagcaaagtcacatctcgtgtggtggcagacaagagagagtgtgtacaggggatctcccctttataaaaccgtcagatctcatgatacttactcactatcacagaacagcatggaaaagacatgcccccatgattcacttacctcccaccggatctctcccatgacatatgggaattatgggagctacagttcaagatgagatttgagtggtgacacagccaaatcgtattacttggtaaaataaccagtttctccaattgtgtcctgttaccagaaaaaaaaaaaaaaaagattcttattgcacttacactaataagtatattgtcataagttaagaatactcacaactagtttgcaaatttggagaaagtaggtagaaacaaatacgctccaaattttgttcaggggaactcctctttataaaaccatcagatcttgtgagacttattcactatcatgtgaatggtccagggaagacccacccccatgattcagttacctcccaccggatccctcctatgacacgtgggaattatggaacctacagttcaagatgagatttgagtgggggcacagccaaaccagtaatgtaaaatacaggagtatactttactcaattgttaaaagctattaatacctcaaaagtttccttgatgctgcaaaacaaaacaaaggatcagcaatgtttgaagcaaagtcaacaagattactttagtgttctattagttcagttcatgcagttaactcctgttctgcttgatatttatgaacatttcacctgtctatgagagtcctgaaagttttttacctctattctaatgttacaatcaccatagttatcagaaacctgcatttaagtgcacctgtcaaagtcttatagctgattataaaccaccttttgaagaggattaaaacaagacaacaattgtctgtgaatgataaaatgtcttaggaaaaaaccacagtcaaaaacacaattgacaaggaaatttggttacctctgtggcatacagtgattttatgtagccattataattattaataacatacagttattcatattggaattgtaggagtttcccataagtttggaacacatatgaaacatatttatacaaatacagtccaaagacaacatcactcctgtatgattttaatatatcaaataagccaaattttacctttacattagtgtgctattattgataaaccaaatttttaataaaaccttataaacaaatctgtttaaccttaattaatttgaccataaggtaatagtctcataaaccttttataaccctttacatttttttttaatgagcagatcagtgctatgaaaaacctgttgtgcttttattccaatgtttaatttatggaaaaactgaatgatgcccttttaactttagccaatatgttcacacacagaatctcttttacaattaatttttcacaaaccttccacaactggcttaaaccttcagctttattttatctaacttaaaacaattatttaaccttttaatcttagggaaaaaaatcctcattcccctgccttcttataatcttttaccaaaaaacacatttcactttctttacacagcttgcatgtaaaactgtttttagtagtctcaattatgtgttatagcgttaactcttagtgacttttacttttgatgaaaaccttggtaagagattttaattaggtactaggtgtggagtctaggacaatggacagaagtgcagataagggcgactgtttccagcatagcaagggggcatggctttccacatgtcccaggtcttatgtaatacacaatgatccaatgtaggtaaattgaacagttttccaaagtcaaagaagcagtttatgaccctaaactacttagaaaacctaatatctgacctgcctaatttggaccaaatgtttaaattttgaagatatctttattttgtcaataatttttgaaactgccttcatttccaaaagattactaaagtcatatgaagtaaatgacattacacattttacttttctgacaaactatttgatttaagcacttactatttttaaactaatcaaagttttttcatatataaacatcgcacacacacacaccatgtacaaatacatagagagacagaaggtccagtagttgtaagatttttcatttccagtttttaagtttctctttaaagcatgccttttccagggtctaataagcagacacagctggaaagcaaaactgatttccaaaaattaagggtcccatttttattaccagatcctggatctcaaaaagatggaattaaccagcctcccatgggaatcttacctctcagtggagagtgaggacatttccataacttgtaggtggccaagaccatgtttctctgatccatacttgcagagatgagtatctcccataactgccattagctagccccaaaagtatatttcctacctagttattacataccaaagctctctcataatgtgaagcaatttctgatgcccccagtgtcaaaaatgtcacacaatgcagtgcaaaacagaacagagccttaaattttgagagggatttatccacttccaattcctgggcttttatgagaaaaacagaggattttttttttcccccaaaatagggtctgtgctgcctcctctgtttttttcaaggagtcccaggctgttagagcttgaatatatgcttttaattaagctgatgtttaactatagcactctttaaaaaatgcccttttaaatttctttctttttttttcctagacagagtctcactctgtcaccctggctggagtgcagtgacacaatctctgctcactgcaacctctgcctcctgtgttcaagtgattctcataccttagcctctcaagtagctgggattacatgcatgtaccaccatgcctggctaactttagtatttgtggtagagacagggttttgccatgttggccaggctggtcacacctggcctcaagtgatccacttgcctcggcctcccaaaatgctgggattacaggcattagccaccatgcctgccccttttaaatttcttattacctgattttagccataccaagtggccaatatgtctggcttttgggctttaccaaatgtaacctccaagtgctcagagaatggaaaaattcaagttttgtggaggagaggagaattaacaaatggtaaaggtagaacagatatcaaatcagaaaggactcattccctaagccaggccaccattgtgatgatggagaccaaaagaaagtactgccacatggttacaggttcatgttcccaaggacatttctcaatgtgtggtctctgggcaagatggtcaccctaagtaacagagaagattggaaaaggaaaggagagagaggaaagcgttgcctgtggcagggtggggaagatgaagagttcagtgaggccaaagaaagacccactcattgcagccaacgctgaatcagaagttcagtctgctgtttgttggtcatgaaaggatcttttctggcagtcccatcagctcttaagtttccccctttagggagagaaaaagcgccccatgtcctatggtcccgtatatgcctaattctgtcacccatagccgtcaacaaagattgcaaggcagattaatccaaagagaataccagttaacatcccatagtgccaaacccattcttaactgagaggtactttactgaaagggtctttctaactccctaaattttaggaaggactctaaccttcctaagttgagcctcaaaccaagtttgctcaagcatccttgccttttattaagaggggcctttaacccactctgtcttaggagagactcttaattcccctaaattgagtctttaacccaatcccattctttacccaggcaaatgcaccccacttacccaaaagtcagccagttggtgtgtgtgtgcagatgattttcctttgggtcggagggtctcctcaatatggtcccttctgtgtttggccagaaagatgttaccagacgccaccacttacctcaagttagcctttggttcgggggtttcctcagtatttttccatctgggtcaccagaaagatgttactggaagggggtcccaatccagaccccaagagaggggttcttggatctcgtgcaagaaagaatttgaggtgagtccataaagtgaaagcaagtttattaagaaagtaaactttatagaaaagaaattccaaccaagaatttcatatcctgccaaactaagctttataagtgaaggagaaacaaaatcttcctcagacaagcaattgttgagggaatacatttcatctagaccagtcttaaagacatccttaaagagtgctaaacacggaatcaaaagaacaaaacctgctacaacgaaaacatataagtatataacccacagccactataaatcaactacacaatcaattttacataacagatagctaacaacatggggaaaaggttaaaataatacataccaaccttgaatgtaaatgggctaaattccacacttaaaagagacacagtggcaggcttgatataaagacaagacgaaagcatctgttgtcttcagtagacccatatcacatgtaatgacatagacagactcaaagaaaaggatggagaaagacctatcatgcaaacggaaaacaaaagaggaacaagagccactagtcttttttttttttttaaagacaggaccatattcccactgcccagactggagcgtagcgctatgatctcagcccactgcatccttgacttccagagcccaggtgatcctcccacctcagcctcccaaatagctgggaccacaggccgtgccaccatgcccagctaattttagttgtttttagtagagtcagggcttcaccatgttgcccaggcttgtctcaaaatcctgggctcaagcgatccacacatctcagcctctcaaagtgctgggattacagatgtgaaccaccatacctgggcaggagccactattcttatatcagtaaaacagactttaagtcaataaaaggaaggacaatgaagggcattacataatgataaagggtacaatccaataaaaagccataactgtcctaaatgtatacatacccaacattgaagcagccagtttcataaaacagtttcttcttggcctatgaaaagacttcgacaaccacacagtaatagtaggagacttcaacaagccactgacagtgttagaaatatcactgaggcagaaaactaataaactctggatgttaactcaacatgtgaccaactggaccaaatggacatctacagaacactccatccaactactgcagaatatatattattttcatgtgcatgtgggacatagattctaagagcaaccacatgctcagtcataaggcaaatcttaataaatttaaaaacaaatgaaatcataccaagcatattctcagaccacagtgcaataaaaatataaatcaatatcaagaagagctctcaaagctacacaaatacaattaaacaatttgctcctgaataactacacaaaataaattaaacaatttgctcctgaataactcctgggtgaacatagaaattgtcagaaataaaaaaaattagaaattaatgaaaatagggacacaatttaccaaaatctctaggatgcagccaaagcagtgttaagagaaaagtttatagccctaaaaggctttcattaagaagttagaaaggtttcgaattaacaatctaacttttcacctaaaggaactaggaaggaaaaaaaaagaacaaccctaaagctagcagaggaaaataaataacaaaaattagagaacttaatgagattgagatgcaaaaatccatacaaaagatcaatgaaaccaagaggtcgttcttcaaaaaaacaataagattgacagaacactagctagattaacaaagaataaaatcagagaagatccaaataagtacaattcgagtttataaagatgacataacagctgatcccacagagatcctcatagaatactgtggacaattctgtgcacacaaactagaaaatctacaggaaattgtcaaatccctggaaacatacaacctccaaagattgaaccaagaagagagtgaacacttggaacagaccaataacaagttaggaaattgaatcattaagcgccatgaaccagatagattcacagtcaaattctaccagacatacaaagaactggtaccaatcctactgaaactctgcttaaaaatcaaggagaaggggcttctccctaactaattctacaaagacagcatcagcctgataccaaaatctcgcagagacacaacaacaaaagaacacttcaagccaatgaacatagatgcaaaaatcctcaacagaatactagcaaaccgaattcagtagcacatcaaaaagttaatacactatgatcaaataggctttattcctgggatacaaggctggttcaatgtaagcaaatcaataaatgtcattcaccacacaaacagaactaaaagaattactgggataatctactgattacctcagtagatgcaaaaaaaacttttgataaaattcatatctctttatgataaccctcaataggctaggcattgaaggaacatacctcaaaacaataaaagccatctatgacaaacccacagctaacatcatactgaatgagcaaaagctggaaccattccacttgagaaccggaacaagacaaggatacccactctcaccaatcctattcaagatagtactggaagtcctggccagagcaatcaggcaagagaaagaaataaaaggcattcaaataagaaatgaagaaatcaaactggctctcttcattaaaaatatgattttatacttagaaaaccctacagactctgccaaaaggctactagaactgataaacaattttagcaaggtttcaggatacaaaatcaatgtacaaaaatcagtagcatttctatatacagtaatgtctaattgaaatatatactaaattatttttaaaacaacttttagattttttcttacaaatttttgcaatgatgttgtgaggatgctttccttttgcaaaaggcttattacataccttttccttttgcaaaatgtttagttctgtaatcatgacataatcaacatgagacatgttagaggattggatgttcaaaatgctgactttcctggcaaaacctatgttgtcaagtaggtgataaaagtgttttctaataaaacaagcacagtgcttatttgttatatgtcagtgcaaaccaaatgagcttgagttttctagctggtcgaattttaaacacaacaaccagttatttctatcgattgcacttatccatttgtttagctttaaaccatattctggatttgttgttttgtcccattacactgttaaaggaaaaagagaaaatattccatgaagttttgctgagacaaaattttggaataaaatgaaatatgagctatgctgtaaaacaaacattgcaatatgaacatatggaatgaagcagctttattggaaaactcagatctgtggaggtggcagcactcatgtttgagattcacaaatgttagtgttagcttaagtgggataatgatgcttaaaaaaagagcagaatttccagtgtgcacagagaaaaatactgataagacttgatttattaaaagtaggaagtaaagtcaagtcatatacagaaaagtcctcacctattacctgaactcaaagggtaattcttttgtattgtatggcttcagttagttggatttacgtaatcttttattttttaatttagcattaaatgctttatatatatatatttattatgccttaagttctaggaagcggatttgcataatcttatgtcagtatccactggcatcgaggtggagccactctaataaatcctgcaggctagatggagaaagaaagttttttaatttatttaacgagttaagttcacttacatattgtaactgaataagtctggcaaaaatagatgacagacaaaagaaccttagagaacatccaacacagtttcccatctcatctgctttgatctctcctgatctcctttcaacttcttcaaatgcctgggaacatgcccacaccaacctaaacatggatggacacaagcttctgcataagagccagaaaggatactgacacaattgaaattgagcatttggcgttcatctatgtcaagcagaaatagattataaatccgtgtgaaattaaaaatagataagtacataaaatccatgcgtgtgtgtgtgtgtgtgatctgcttcagcaactcatcatttcttcctttaaacttctgtaaagagaggtagggcacagcaaatagacctaaggaacttgagttaaaaatttacaaagcatcactttatgacacctctaattaactccctctcctttgaaagaatggagaccactagagaagtggtctgttaccttaaatgagtcatttcaattctgagtgaggcatgaatttacttaatgtcatagctttaggaaatttgatcaccatattcctttaagttattagtaatttaatagggaaaaagtaagacatggaatgaaatgaaagattattttatgtgaatttttgtgaacagaggaatattagaaagaaatagggtttaggaaatagtctataatttgctgaagataagtctatggtagtaagtgattaattcagaagtagttacatcctgataaaatcaaatactttatgcttgtgaaaattcgaacacagtataagaaagtagacatgtgagcaatactgtggtatttttgtacattcttcagttggaagattcttcacttgtagtaggcttttggcagatctgggtcattgttatcctaggcagagttggggtggggtagagattggttaataccttttgccattgctacattttggattttgaatttctgaatctggctaagtttgcaatacatttttattctctaatgtttcctaaaaattctgactttcctagcaaagtgaaaactgttaaaggtgactcaagaagaaaaagaaaactcaaatcttcctatagcatgagagaaactgaaccattagcttatttttccttaatgatagcactaggctcaattgattttattggtaagttttactggagctcaatgttttatacacagtgttctagaagattgatgagaaaacctagcccatctcattttataaattttgtgtaacttcaaaaccagacaaggataattaaagaacacaaaactgtaaatcaatctcactcagaaacataggtgcaaagtttttatagcaaactgaatccagaagttttccagaccaagttgggtttattccaggaatggcagattgacctaacattagacattgtattaatataatttattacattgattgactaaaaagaaaactataccatttcagtgcatgcagaaagagcatttagtaacattaagtaccagcttatcattaaaagaagaaattagaaacttcctttacctgataaaggttatctaccaaaaacctgtaacaaccactatatttaatggtaaaatattggaagcattagctttaatatcagaaaccatgaaacctactgaaactaattatatttattgttgtactcgatgtcctaggacaggaggtaaaagaaataaaaatgccgttcattgacagaatatgattttctacatagaaaatctaatttaggccatatatactgcttattagaattaattggagtttaacaatgttgctatagataaacatcaatacaaattgaaaataaaaactttaaaaaacatcagtatctatggtagtgactataggtatctggggataatctttaaaaaatcatttgagacctttatggaaaaattatgacttaaaataattaacattttttaaaaaagactatgttcacagatagattcattgcaatataagttgttgcttaatggatctctagagtcagtccaatttctaagaaaaccaagtgggtttttttttgaaaaattatgacttaattaaaaaaaatttaaaaatgttttttaaaagactgtattcatagctagagacatttattgcaatttaagttgttatttaatggctctctagggtctgtccaagttataacaaaatcaagctctctttttttcttgaaatgtgacaaattgattctaaaatgttgtagatgagtaagagcccaaaataaccaagatactccaaagaagaactgagtgagggctgatttctgctacatgttgaagcaaaggagccccccacatgtagatgttgtggacatcacttgtctctgtcccttaagagaccccaaaacacacagcactgatgacacctgttctgcctctcacctaccatgggaccagatgaggttgatttaacttgacttgtcctcctaggatgttcctcctatcttactgaactgctcttggggattaaatgacaaggaatataataatgcctaatacagggaggactttgacagtgattcagcagtgaatctagagccagcctgcctgaattcaaatctcagcactacttcttatttgctgggtggttaatctttctctgcttcagttttctcatctggaaaatggaaaaaatagcagtacttcttccatatggctatcgtgaagattaagtgaattaatacatgtaaaactggaacatcacctggcacatagtgctcagcaagtattagctcttcttttcattttgtttacacctttattcttttcatcaaaatgctttcatccttgtgttactctttgacaatactttgcattaagtttaatttaatgttaaattgtattcaaatagtacataccttaagtgataaacacaataacatatttatttaacatgtgaatagtgaacacctggtataggctgaggtttaaagtgtctaggaggtcaaataactatcagtttattagggagatatttttcaatgaacagcatgattactgagatccactacaatggggatatgtaaatagtacagtctaaacataaaaaaagggtgcctgagtgaacctaagcaaatcagtccagaagacttcataaagaatataggattttctctgagattgatgaatgagtaagtgtcctggacacataaacatataagccagccattcacagaaatcagttaattaaaaacctttgcaaggtgtggcaacagtgtgtgttgatagacaccaacaaatcagatcaataatttcatttccttaatggcaaatgatacagaaaattatggaaacagataaatcagatgatgacacagcatactgtcacatggagatatatcttttcattttttcatggagtcttacagctgtggattcatagcaggcttgagtactctcatttcctttatcctgaccccagcttccttgtggaagttggcttgatgcctcctggaggctcttcttctggagacttgatatgaggctacctggtaactgaaagcaagtgactggtacatgtaaagaacaatacagtcctagatggtggttacagtgaggtcagagtcagtttccagaagtattcattggaccaacctccagcatatcccagatatgttcctcatattgagccggggtcctcaagcctctctcatcatttaagttacataactagtagctaagtctgagactcgctccctagtccttcaacttgtcttcaccaccaacttttctttcccaagaggcataatggccttgaagaaacagctttatttaatcatacagactgcagttagaacctactacttattaatagctgtgttttcttaagaaacttattttcatgtataaatataaatctcaattccttatttgtaaactgaggatgattatagctaacatatagggttccatgagctaacatatacaaagtggcttgtgcattgacagatatttaataggaatgtaataaattgtttatattcttttttccatattctaaaattgaactgtatccaatattaaatccacctgccccctctgtcaatattctgtgcttcacagtgctaatgattttctattacatttttttcagatatacccccatgaaagaacctctgttaaattttcagtaaattaaaacttaaacgtctccagatgggtccatgaatgactaaaaaaaatcttctagtgaaaaataacaagatcgtcaacagaaaaagtgacaaacataaagtatatctagccattatagaaaatgtaaaaaaaattatttgtattcacattaggcctattttaacacacaacactgtgtaaatgtccagattgacttttgttagaccatattgtcagatttattttagtagaagatgaagcacacacttcataatggagtataaaatttaccaaagttgtagataatccattcaaatggaatgtgtctatatgtgttttggactacttaacactgcaaatgcaacttcaaataattaaattaaaaacataaaaattattcccaaaagtaatatcatgggctactttacattttattcaatttaatctagcaaaaaattttgaatgccagatactgcaaagaattctacaatcacaactaaggggatggtcactgaccttggaagagctgatagtctagtgagaaataaaacaaatatatgaattaattataatataaaataaaataagatgaacaaaattggaagactaagctataaggtccactaagcagtggctattttttttcatttcccccctatgtatacaagtgtttatttgtattatttttacaatttggggattgtgctgtgtgttttgattccagcttattttcatttttcattgtatcatggacattgtttcatattcttaacttgttcaaaagtcgtgtttaatggccataaggtattccatcatatgatagtaatttaaatattcctctatttttgaccatttagattgtttactcactgctacaagcctcagaagaaataaaagagcaaaaatacccctaaacatttattattaatgtaaagtgtgttcaaacatgttttctactacatacattaagcaaagttactatcagatcttatattattgtatataattttgtagatataattaaacagtactactcagattaaatggggaaaaaaaacccaacacaggtagattttcttcttcttcttcttctttttttttttttttgagacggagtctcgctctgtcgcccaggctggagtgcagtggcgtgatcccggctcactgcaagctccgcctcccaggttcacgccattctcctgcctcagcctcccgagtagctgggactacaggcgcccgccaccacgcccggctaatttttttgtatttttagtagagacggagtttcaccgtgtctcgatctcctgatctcgtcatctgcccgccttggcctcccaaagagctgggttacaggtgtcagccaccgcacccggccgtagattttcttcttaacttgccttgccattcacatgtatatacctaccacacatagattttcataattgtacccaaatgctatagtttattgtgtacttgctattatttgctataaaatatttctttataataaacctattgtgttttggggtggtctactattaaaagtatagtttttttgttttttgtttttttttttagacggagtctcgcttttgccaaccacgctggagtgcagtagcatgatctcggctcactgcaacctccgcctcccaggttcaagtgattctcctgcctcagcctcccgaatagctgggattacaggcacttgccaccacacctggctaatttttgtatttttagtagagacaggggtttcaccatgttggccaggctggtcttggactcctgacctcaggtgatctgcccaccttggcctcccaaagtattgggattacaggagtgagccaccatgcccagccaaaagtatagattatcaacaataaattttaatattgggagctattcaaagtgcattctgtgtactttttctgtctcatactttctacagtctcatcctttctatagtctcatcattaattttataaaaatatttatctttgaaatatttacttgtgtaataatgactttgttattttaacaaaagagtaagtattcatgtattttggcctgtggttttttttgtttgtttgtttgtttgtttgtttgttttactgaatagcttgtggcttgccatctttatttaaccatctggtgaaatgtttctcttccatactaaaatggctttattctttaccattttacttgttaaaacttttattttagtatcggggtacatgtgtaggtttgttatataggttgtgtgtcacggggatttggtgtacagattattggccacacaggtaataagcatagtaactgataggtagcttttccatcttcaccctcctgccaacctcagccctcaagtaggcctcagtggtttgctgccttctttatgttcatgtgtactcaatgtttaactcccatttataagtgagaacatgtattcagttttctgttcctgaaataattagcttaggctaatggcctccagctccatccatgttgatgcaaggacatgatctcattcctttttatgactacatgatattgcatggtgtatatatacaacattttctttttttttttttaatttccaacttttaagttcagggtacatgtgcagaatgtgcaggtttgttacataggtaaacatctgtcctggtggtttgctacacagatcatcccatcacccaagtattaagcccagcatctattagctattcttcttgatgctcttcctcctccaacccaaagccctgcatcaggctggtgtgtgtcattgtccccagtgtgtccatgtgttctcatcatttagctcccacttataagtgagaacatgtggtatttagttttctgttcctgcattagtttgctaaggataatcgcttccagctccatccatgtccctgcaaaggacatgatcttgttctgttttatgactgcatagtattccatggtttatatgtaccacattttatttgtccagtctatcattgacaggcatttaggttgattccatgtgtttgctattgtgaatagtactgcattgaatatatgtgtgcatgtatctttataacagaaccatttatattcctttgggtatgtaatcagtaatgggatcgctgggtcaaatggtatttctgtgtctaggtctttaaggaattgccacatcatcttccacagtggttgaatttacactcccaccaacaatgtaaaagtgttcccttttctccacaacctcaccagcatctgttgttttttgatgttttagtagtagccattctgactggtgtcagatggtatttcattggggttttgatttgcatttctctaatgataacagtaatgttgcacttttttcatgtttgatggccacatgtatgtcttcttttgagatgtgtccttctgttcatgtcctttgcccactttttaatgaggttctttttttcttgtaaatttgtttaagttccttataaatgctggatattagacttttttcagatggtgatatggtttggctgtgaccccacccaatctcacattgtgggtgggacccagtgagaggtaattgaatcatgggggcagatctttcccgtgctgttctcatgatagtgaataagtctcatgagatctgatggttttaaaaaggggagtttccctacacaagctctctctttttgtctgccatcatctatgtaagatgacttgttcctccttgccttcccccatgattgtgagccctctccaaccacatggaactgcaagtccattaaacctctttgttttgtaaattgcccagtctcgggtatgcctttatgagcaatgggaaaacggactaatacagatggatagattgcaaaaattttctcccattctgtaggttgcctgtttactctgttgatggttccttttgctgtgaagaagctcttaattagattcatttgtcaatttttgcttttgttgcaattgcttttggcatcttcgtcaagaaatctttgcctgtgcttatgtcctattgcctaggttttcttctagggtttttatagttttgggttttacatgtaactctttaatccatcttgagttgatttttgtatattgtgtaaagaaggggtccagcttcagttttctgcatacgattagccagttctcccagcaccatataaaacagggaattttttctccattgcttgtttttgtcaggttcatcaaagatcaaattgttataggtgtgtggttctatttctgggttctctattgtgtttcattgttctgtgtgtctgtttttctaccagtagcatgctgtgttgtttactgtagccttgtagtatagtttgaagtcgagtaacattgatgcctccagccttgttctttttgtttaggattgtcttggctatttgggctcttttcaggtttcatatgaatttcaaaatagtattttctaattctgtgaagattgtcaatagtaagttaatgggaatagcattgaatctataaactgctttgggcagaatggccattttaatgatatcagttcttattaatgagtctggaatgttttccatgtctttgtgtcatctctggatttctttgagcagtggtttgtagttctcattgaagaggtccttcacttcccttattagctgtattcctaagtgttttattctttttatggcaattgtgaatgggagttcacattcataatttggctcttggcttgcctgttgttagtgtataggaatgctagtaatttttgggcattgattctgtatcctgagactttgatgaagctgcttatcagcttaagaatctttggggccaagatgatggattttctaaatataagattatgtcatctgcaaacaaagatagtttgacttcctctctctttatttgaatatgctttatttctttgtcttgcctgattgccctagccagaacttccaggactatgttgaatcagagtgatgagagagggcaaccttgtcttgtgctggttttcaaggggaaggcttccagcttttgcccattcagtatgatattggctgtgggtctgtcatacatatatggctcttagtagctagaggtatgttccttcagtaccttgtttattgagcatttttaacatgaagggatgttgaattttattgaaggctttttctgaatctattgagataatcatgtggtttttgttgttagttctgtttttgccctgaatcacatatattgatttgcatatgttgaaccaaccttgcatcccacgggtgaagccagcttgattatgatcgataagctttgtgatgtgctgctggacttggtttgccagcattttattgaggatgtttgcattgatgttcattaaggatattggcctaaagttttttgttgttgtatctcttccaggttttggtatcaggatgatgctggcctcatagaatgagttagagaggagtccatcctttttgattttttggaatagtttcagtaggaatggtaccaagctcttctttgtagcactggtagaaatcagctgtgaatccatctggtcctgggctttttttgtggttaggctatttattactgcctcaatttcagaactcgttattagtctattcagggattcagtttcttcctggttcagtcttgggagggtgtatgtgtccagaaatttatccatttcttctgtattttctagttaacgtgcatagaagtgttcatagtattctctaatggttgtttgtatttctggcatcagtggtaatatcctgattatttaatatcccagtatttctgattgtgtttatttgaatcttctctctttttttctttattagtgtagctagtggttttgttttgttttgtttttctttgagatggagtctcgctttgtcacccaggctggagtgcagtggcgcgatctcagctcactgcaacctctgcctcctgggttcaagcgattctcctgcctcagcctcccgagtagctgggattacaggcatccgccaccatgcctggctaatttttgtatttttagtagagacgtggtttcaccttgttggccaggctggtctcaaactcctgacctcaggtgatctgcccacctcagcctcccaaagtgctggaattacaggtgtgagccaccacacctggcctgagccaccgcgcctgacctattttattaattttttcaaaaaaccagatcctagatttgttgatgttttgaagggttttttgtgttgctgcgtttttcagttcatctttgatcttggttattttttgtcttctcctagctttggggtttgttttctcttggttttctggttcttttgatgttctagttcttgtgatgttagcttgttaacctgagatctttcctagcttttttacgtgggcatttagtgctataaatttcctcctcaacactgctttagctgcatcccagagattgtggtgctttgtatctttgttctcattagtttcaaagaacttcttgatttctgccttaatttcattatttacccaaaagtcattcagagcaggttgttcaatttccatttagttgtatggttttgagtgattttcttaatcttgagttctaatttgattgcactgtttattatgatttcagtacttttgcatttactgaggagtgttttacttcagattatgtgatccattttagagtatatgctgtgtgacaatgagaagaatgtatatgctcttctatttgggtagagagttctgtagatacctatcaggtctgcttgagctgtcactcagtcaggagaactgggatcagggtcccacttaaaggagtaatctggctgcgttttggtggagcagctgtactttactgaggaccccttttgtccctgatccatttgggctgcccaaggtccacaggctggaccagctgagaaacccaaacagcaaaggtggtggcctgctccacccaccatgcccgctgtcttagagagaaattagaactcttgtcagctgtagtacacagagggaggtggctggagaccccaagtgggaggacccaccctcgagggggatttgtaactcggggtctcatttaaagaagcagtctggcaatgcctcaacaaaacagctgtgccatgctgtggaaccacttttgccctggtcagcttggactcttcaaagcccgcaggctggaaccgctgagtcgtcaaaacaaccaaggtggtggcctgcccctcccgcaaggcactctgtccgagggagagaccagacctctgtccatagaatatgggctggtagggggagctcaggcctctggtgggaggtcccacttagcgagaaggaatagatcggggtcctgcttgaggaagcagtctggccacattctggcaaagcagctgtgctgtgcggcgggactcgctgctcatccagaccgtttgtactctgcaaagcccacgggctggaatggctgagttgtttaaactgcagagatggcagcccacctctccccactggggttccatcccctctcaggcagcctccacactgtttccagctgcctggaattccaagccactgggtcttatcttgtgaggaaatggggcctgtagaactgacactgctcagctccctagatttagccgccttcctaggggtatgtatgaacctcctgccttgctggggatcccggggccagagtatgtaaagctctgggtctctgtgctgcctgagcaaccgctctgttgagactccacagagttctgtgtgttggacccaaggccctggtggcatgggctcatgaggggatctccagatctgagggttgcaaagatccgtggtttcttagggttgtacattcgttcactgcttcccttaactgggggtgggggttcccttgactacatgtcactcccagttgggccatcacctcaccatacttttcttcattctccctgggttgagttgttttcctgatcagtcccagtgcaagtacctggatatttcagtagaaggtgctgtatttactcaccccccttttgttgctctctgtgagtgccacgcactacagttgcttctgttccaccgtcttggcccccgatcccttgttttttttttttaagttatttatttttatttatttttagagacaggatcttgccatatctcccaggtttgaatgcagtggcacaatcatagttcactgtatcttcgaactcctgggctcaaggaatccttccacgtcggcctgccaaagtgctgggactacatgcatgagccaccgcaactggcctgtttccttcgtctagaaaatgaggctcttagtagttcactggcatggtgtaaggagtgaattatggaaaatatgtaaagcacctaccacaatatgtggcatatagtaagcacagaataagtaaccaattccttctcttttcttcctgtttacaccgcaatttagagtattaactggcctgtaaaagattctgtaaagaaaaatgctgtatcagttagagccttttaaaaagtgaaaatatctttcggggatcttcctcccatcaggcaagttgttggactagggtcacttctaaggtttcattcctatgctgtgattttaggattccgaaacagtgaaaataactggtatgcttcattaggcagtacagtgtcaagtttaggataatttactttgacagatcataaaacagatgttaaaacatttataaacctcaatgaattattttttaattcacagtccaattatcttaagattttaagccatgcttgttttagatttccttgaatcataatgattttgtttgcgtatgaaaagtaattccaattctgtatcattatgagacaaaatattcagtgaaactcaaactgctttttttttatttttcaaagcctttttttccttttgcatcgactttatttcagttcttcataagaatataaaatatactccttttcatcagaacttttcttccacagccactaagttcatatcatatgactatttggtgggtaacaatattagcaaatatgtttatgatatccattctttatttaaccttactcttaataaatggagaaaattatgaaatcaaggtacttcccacaaggaattcttaaagggctttataccaataacttttgtcttgtgacttctgttttctttgcctagaaggaatggaagaaatgagaggaaactgatctcatttgttttactctctcagtggctagttattatttccctgcagcctgaacattggttttgttacagagctttgtggactgccttcttgtttcatgcatagactatgccaaccttggatcgcagtggagggcagaagctatttagaagcacccaacagtgtggcttttattctgattgttttcaaatgtgcttagttggctcaaatcaggcttcccagaacagaatcttagggtggggtttagaattagagcagcatttctccagaaagatttacgctgtcaaccttttataaattaggactctcactgggcttgctctaattctttaaaacatttgtattccaattgctttcatctttggttgagctgtctggatcagatgtggccgttctctctgattttgcttctgatacacacttagggcctgtgcagtttctctcctttacccttaaggggcagacttgactaaaattcaaagatatctgtgttttctattgctgccaaaatacccaaataccgttccaaaatacccaaaacttaaagggtacacccccaacttaaagcaacacagatttaatgtcttacagttctgtaggtttagagtccaacacacatatcaatggtctaaaatcaaggtgtcaacagagccgcattcctttctggagaattctctaggggactatctgtttcctagccccatctaacttcttgcggcctctcacattttttggttcatggctcttcttctgtcttcaaagccacagaaattgcatctcgcgcatctcgctgacccttcttctatagtcacagcatctgctcaatgaccacagctaggggaagttcaccaattttaaaggcatgtgattaggttgggcccatctgggtaatccaggctactattcccatctcaaggtttttaattacacctgcaaagtcccttttgccatgtaaggtaacatattcgtagttcgaaggattaggacatggacattttggggacaattattctgcatatcacaatccctttctcttttccttagtagaccacactagtctggtgacttgaaggaacctagccatttctcttctacctcaccacagtgggcccaggatatagtcattttaaaaacataaaacccagtgtatcaggctccaggccagggcttctcagctgactgtttctattggtgtaacagactggattttggctgtctctccctctactttcctccagcagtctttggtcttgttttgagatgttttccctcctgtggtcctcagtctgccagtgttcttcctataactttatctctgtgtgtcaggatatacactgtactctatagaaatggcagtggaaccccaacaattgtgggtgtttgggtaataatccacaaccttatcattcccaacacccttcccattgtagctttcctctataaagagaagtttggagctcctaaaaccagatctgaaatttatttattcaattaatcattcaaatgtgcaagatgtggggagaattggatatagagatatggctcctgccctcaagaaattaatagtcaaacagggagaaggacatgaaatacaagcattgctgtatgtgggatggatgtctgtatatacagttggtcctctgtatgtatccctgtgttcttcatctgtgggttcaaccaaccacagatcaaaaaaattgggggctaggcgtggtggctcatgtctgtaatcctagcactttgggaggccaaggcaagtggatcacctgaggtcaggagttcgagaccagtctgaccaatacggtgaaaccccatctactaaaaatataaaaattagccgggcatggcagcatgcacctgtagtcccagctactcaggaggctgaggcaggagaattgcttgaacccgggaggtggaggttgcagtgagccaagattgtgccactgcactccagcctgggtgacagagtgagactctctctcttaaaaaaaaaaaaaaaaaagaaaagaaattagaaaaaaaaattgtactgaacatgtacagactttttttttattgtcattgtttcctaggcaacacagtgtaacaatcatttacatcatattatgtattgtaaataatctagagatgacttaaagtatatgggaggatatacatagattatatgcaaatattacactattttataaaagggacttgagcatcttcagattttggtatctatggaaggttctcaagccaatcctttatggataccaagggttgacatatgtgtatatttatatatgtgtgttagttatctgttataatgggagcacaggaaagataagcccttaaatttccctcagggattcagggaaagttgtccagaggcagctagggttgagcagcagatgtcatgacactactaaccagataagtcttctcctttcactcaggccttatggaataagctatgcttgtggaattttttatgtggaaaagaattacatgaaacaatctgcattgctcttctcactgtttttagagggaatcagtaggaatcagaatactggctgactctttaggtatgtgggcttatatgaattttttagctctttaatccttagtttttccattagtagtacccaacttgctgaattgtgaggtttgaatgaattattaaagttaagcttttagaatgggacctactacccagaaaatatttaacaatattattgtaatgtatcactgtcaccatttattactacaatctctcttgaattactcatcacttttctgacatcatcatatgaaacaagttttttaattcatgccagcttctccctcttacttacggtttaggagttgcctctaatgcctaaggaaacgtgtagccctctggttgtactgcaaaagtggttgcattttgaaggcaggtgtatacaacttccagagtaagaatatgtgtattcaggtgtaggcgttgtcagtttccaataagataatttataatgcttaatttatattaggaagatctcacattgttctcttctgtaaattatgcatgtatttgtaaatctaaaaggaactttgatttttctctctgattaaggtgtataattataatcttaaataaaagtgaagttcaaagtagcttcatttaaaatattaatagacaaaacataagatcagttcttttagggattggtttgtcagccacatgttagatctgcttagaaatcttcagtgaaataggaaacattgtataaatgttacctaatgtaaatactgctaaatttaagatatactaaaatttgagtattttccctttagtctcaaataagcaaaaggaaatctgagttatatgaaaatgaaagcatgtattcagcttttataaaaccattataaataagttatttttcctaccaagttaaataggatatgtttacatgttttaaattttagttttattagttacagtatcatattgtgaatagtagcaaatatgtccttatatagttctgggttcttgctttataatgtacatagacaaatatctttttaaaaaaatttttgtgttccacagacgcaacaggttttgataatttcttatttcacctgttggttacagtcacaataatatgttctttcttctaccttatgattgaccatttctgacataaaagttaagaatttgtatcatctaaacagccttttatgtcctttctcttttttcatacatcttgataattgtagtgtttttcatgtttgcttctattttctatctttccgagtttgcaaaacattattaaaacttcatttctagttcttcactaataggacccaaatctaagtctctcaacttcaggctctacttaagtatccagagttcacaattcagcgaccgtttccagggtggaggcctgtagaagaatcagtcctatttttacaaaaacagagaaatttgtgctcctaatatttgcatagtcataaaattgcaaaagttatattggttttacaattttaaattgataggcaattatgatttttgcaaatgacattctaataaaaattatcaacatttggttatggtagcgatggtgaagaaacacagtgaaagcaaatattttcttatgtcacttatacatgtacaacaatggccatatttctgaaatgtaaatgaaagtataatgccttcttcgatttttattttgaccactgagtaaattaaaccttcaataatctcataaaaatgagatattttcttgctatacctctgatatcccctgtcccctgaaaaaatatgaaattagtacagagccagtaaaaaataccaagaacacccaggatagattctatcctaacctaaacaagcttatattatgaaagtggtgttattttttaacagatcataaattagacaatatagttcatctagggccgataacttctccccatgcagctgttgtcactcttgggaggtgcttcctagaatgtgtgctgagaaggatgctataattagtgatgtctgccttgggtacagaatatcagtagtggttaggagcagtacacattttccatccttaagtatctggatgggaagagatctagagaacagaatatcatatgtctcctgactcataacttgggatctttcctcaattctactgaataacctgtagtggaaaaccatgtttctatagtcctatccctcgtccaggtggattatctgaacaggactcctgtggaatggttgtggtaatgtaattcatgtggacattgacaagttgccatcatgtggtcatgaggatggtgttggattccttatgtgtgaggctgataagggccctatgttcaattcttagtggtccttttaaacctacacctgtttatattttttatcaacatgcccataacttatttttcgtgaatccactgaaacttccagagacttgaactttgcctaaagtttaaaacaggaattttttaaatcccttaaatgaaaaatagttttaagtgtatcccaactaatatgaaacaggaaactaatgtctaatatccttgggaactataaaatattcaatagtaatcaaaacataaaatgattctcttctgtctttccgttattctctacttccaattacattttgtaaaatgtaaacaattgcacctgcaattgatggaaaaataccatcatgaaatcaaatgtgttttctgacttcatatatgtattgtagtatttaatattaagtaagctcagaagatacttacatggaatctactgccttttctgagcacaagagaagcaatgattaatagaatgtggtacttgctccaaggagcattcatttaagaggagggatgctcctatttgggtcttcactgtataaagcatttatatgtatattacttaacaactaaaaggtatgtacttatgcagaatactgccatcattgctcttttctttactgtaatggtaccattcatcaggtccatggaagccagcttctcacacattctctcttagacataggcgttttctttctttcttttctttttttttttttttttggtgacggagtcgcactttgttgcccaggctggagtgcaatggcacaatctcggctcactgcaacctctacctcccaggttcaagtgattctcctgcctcagcctcccgagtagctgggattacaggcgcgcaccactacgcctggctaatttttgtatttttagtagagacagggtttcaccatgttggtcaggctggtctcgaactcctgacctcgtgatccacccgcctcggcctcccaaagtgctgggattacaggcatgagcccccacacctggcagacgtgtgttttctaaagtggatttattagaaattgggatccccttaaccatctttacttagaggagactttggcttagtgacctacagttgtgtgtaaatgaaaagcaaaattaatgggaagtatactcacaaaagaaggactttaaagttgcaaaaatagcatgcatcaagaatagtataaaattttaattcctccatcgtcaccaataaacatttatggagaatccccagagtgactgactctggattttacatcttatgttaaactaactcttgcattctgttcttgctgttttataattaccccaaatgttctctgttacttctcctaatgattcttctttttttttcttttttctttttttttttttttttgcatacagcagagaatgcctgtgggtttaaaaattttttaactaatcttgatgaatcaattataatttataaaagtggagcataacagttaagagctcatgctatggaattggacagagctgatttcagatactgttctgccacatgcaaagtgcataactggactagtcacttacctttctgaacctcagtttcctcatctctgaaggggatgatgaaggttcagccctctcatagggctcatgacaattaatgagataatgtcacatgcttaataccagcatcttgtatgctccataggtgttagctgtctgtttgtaataatatttttgtgtttggttacacaaacccactttcttcatttgttttctgctattaatgccttttgaagtattgtgttgtttgtgaacacatagtacaaattgacttttgtttttttaattatcaattttgtttctgtaactgcacagaaaagtgataaattgtgagcttatattttcttttaatacatagatatcgcctcccaacatacatgaattttaagacactaaaaaccccttaaagatcttttcttaatcagtgtttagtaaatgggcttacattctagcgtatagaccaattcaaactgttctacagtagagaggaatttgtatgttggccagtttttcatacagtgatttctaactctttccccttcagtatttccctaacatacactttctcatccagtatttcttttagaattctcacacttttgccctcataactcactttcatattcctagagctcttttcttcacactgattgtgctgctccttttcaatttttccaaccttatggaattattagtgagaaaaagcaaaattattattatttgagacggaatctcgctctgttgcccaggctggcgtgcagtggcgccatcttggctcactgcaagctccgccccccgggttcacgccattctcctgtctcagcctccggagtagctgggactacaggcgcccgccactacggccggctaattttttgtatttttagtagagacggggtttcaccgtgttagccagggtggtctcgatctcctgacctcgtgatccacctgcctcggcctcccaaagtgctgggattacaggcgtgagccaccgtgcccggcccaaaattattttttatatatggtgactttcccccaccctttcatcttacagtagaggcagctcagaaaaaaatcactgaattaagtcattcagaggtcgtttataatagctattcagcagtgagctggttctcagtcctggttatccattacaatttcccagcatttaaaattctgataccgtgaccatacccaagaataattaaataagactttctgtaggtgggacctaggcatctgtttttaaagcccttcaggtgatcttaatgggcagctaagtatgagagctactataggacagtgttgtatggcctgattaggtaggaatgagagggagaggaagaaatcaggacaggagatgtagacttattttgataagttttggtagtgaaaggcagaaaagagatgggactgtaacttaaggaattagcaggaaacacaacatacctgagaaagaacattctagcatatatatatatattagcatatatagtagtgagtctcagctactcccctagggcagtgtatcagcaatttaggaaccagggatgaacatgcatttggcaaaacttcctaattttgatacacctttccctttctcactaccctcccttctctcttctctccccagcccctgtctacaatactgctatcctgctccctctgctcctcgtccttttctttcttaaactgggtgacagagcatctcaaagttgacttccctcatggtggccatatggctccagcagttctcagcaagagttctgaattcaccctgattagaccattaaggtcgtatttcaactagtaactgaggctgggggaatggaatatgctcatttgtgaagtcaatcaagaaagtacataggaagatgggaaaggatgctggtagacagccagtactacccactatatatgtaaaagtcacagtgattcaatgcaatcagttattttacatgtgcaaattatgagtggtcttgtatggggacggttttgaataacatatagaaagtactatatagtactgatatttttctgagcatcaaatatttagagaaaaaaatctgtggtgttttagaatataatataataaacatcaaataatttactagatcaaacatggtttattaacttaaacactgtagcatatagcagtctgtagcacatcttactgactgatccttttttgaaaaaatcattacttcacattgttgatgttgtggcagaatctaggacttctataattacatttctggagattatcaggcaaatgtgtggcttttaccttttctggttactattttatagaaaaatgtaattgctaggtatgtcatttaagaccctgcaatctatttgtctgaaaaatggaacaaatgctagtaagaattttaaatgactctcaaagcctcctgcaaaatgacattagcagttgaaataaaatagttaacagtctaaaaactgtttaagataaagcccataactattaattttaggactgttttgtatacaatgtaaatgacacatgtttgagttaatccatttgatggtggtgatcacattcttaagaaatgatttggtatctcaaagcagtttcttaactagacaatgagcagaaaacctgttgctagttttggaagtttaaattgtcaaacttcaattacttctgtttaatttgggattaaagtttgggattaaaaacacatgagcaaaaatctcataaccccagttcagtcatgagagaaacaccagacaaatttcagttgagggatattctacagaatatatgtccagtactcctcaaaactgtccaagtcatcaaaaaacaacaaaagtctgagaaactgtcgcagccaagggatactaaggaaacaagaggactgaatgtaatttggattctggatgggatcccagagtggaaaaaggacattagagcaaaaccgaggaaatctcaatacaggttgggctttagttaatgtgtcaatactggttcattaattgtgacaaatacactatattagtgtaggatgttaataatattaacaatggtggaaaccggttgtgggatatatgggaaaactgtgtactgttttcatagtttttatctaaattttaaaatacctcaaaataaaacgttatttttaaagatgtggggatacatttttcaggaaagagtctccgccataagcttactatagcagagcctgaatgctactgtttgatgaatgaaagaagtccggtattcttggagatcttctctgtaatcctccaggctgaggcatcacttagatttggcatttgagacctttattgttgacctatgaaattctgttttatgtctgtctctcactttgtttcaccatagtatagtataggttataggagcaagaaaactgatttttctttcaagatccactgtatgccaatcatgtactggatttcactaaaattaacacatccaatttttagaaactttgtaggatagaggactaccctttctacaaaagaggaaaacagactaagaagagtaagttacttggccaggcacagtggctcacacctgtaatcccagcactttgggaggccgaggtaggtagatcacttgaggtcagtagttcgagaccagcctgggcaatatggtgaaactccatctctactaaaaatacaaaagttagcagggcattgtggcttgtgtctgtaatcccagagaattgcttgaacccaggaggcagaagttgctgtgagctgagatcgcaccactggactccagcttgggcaacagagcgagactcagtctcaaaagaaaagaaaaaaaaagagtaagtaacttgcccagagtcacacagatgtttactgacagactacatgagagccttgtttattacttgactccaatttccagcctttctaccttctcatatatatgccttctttgttatcgtaagattcagattagcaaggtactctttttaacctgtgcctatgttttaaaaaaaaattgtttaagtttgacataagtataagccagcaggaagttgcaaaaacagtacagatgctccccaacttatgatggggttaccttccagtagactcattattgaaagtatcgtaggtcaaaaatacatttaatacacctaacctgtaacttagccttgtatgctttaagtgtggtcattagcctacagttgggcaaaatcatctaacacaaagcctattttataatgaagtgttgaatatttcatgtaatttattgaatactggaagtgaaaaacagaatggttgtatgagtaaagtacggtttctactgaatacattttgcttttgcaccattgtaaaatcaaaaaatttttaagttgaacatttcttaatttggggactgtattagttcattctcacaatgttataacaacatacctgagactgggtaatttataaaggaaagaggtttaattgactcacaatcccacaaggctgggaaggtctcaggaaacttgcagtcttttgcatttcaccatgaaagagttcgtccaactttttaggtttttattacaaaataaatagtgttttctctgccctctctgtacctcgtatttgaggaattctcatacttctctttcaagatgtctttccccacccattttgtttatggtggtaatattataccaatatggccagcttttatgtactttgtgatctcgctactatgaagttagcccccttcagcatttattcagaataatgcctcttaaaaaagtgtttaatgatttcataaggtccttggtgtttcttaatgtcttcctttctcttttttccctccccttttcccctccccttttctcccctcccttctcccctcccctccctcccttccttccttcctttcattttttctctgtgaccatctgtatgttcttttctttttgtctgccttttagtattaaaatggtcacctgacgaccatctgagttgagctttgtcaagaaccaagggctgaagttctttttgttcagactatgtttctgttaccagtattgagggactaaggactttcaagcccttctcattctcccagcctgagagatattaagataagggaaaactagattttgcaggtaaactttgatttgttgaatgcctgctttgtgccagacattgcatgctacgatatattctattaaaaggattcaggaagggcatttactcttttagctactggagtttgattttctttattatcatgctgatcagtgtacactggcagtgtggctgattgagtggaaaagggagagctacactgtcttgtcactcacctagttgataacagattcaggacaaggactctcgtctcctttctaatacaatattagccctaaacccaaagaagttgagatgttttgtcattctttagtttttcccaaagggaacatttttcacaacataaaaagttagctgattggaattaacttatactttataagagatcagtgcatatctagaggcgacatagtagaattttcaaacaatcagaaatctcataaatcggaatctaagggaaaacaaatataccctcctgaacgttgtataattgggtatacagaaaactttctaattttattttgccttcatttttagactaacttgcaattaccccaagttgctaggtagcaaaattattatggtactagctcagaatttgctgtattttaatcagccttagtgactgaaaacacagagagaatgtcaatgagggagaaaggttttcctttactgcccctagataaagcagatgaaaatctgtttctctccacggtagattcctactccttgccaaagatacaatagacaacatttataaaaatacaatctttgtgcatgttgctaggttgctcaattttgagcctttttctttacaatacataatcatttaaaaaatactgaaagaggtaagaaatagggagtggaaaccagtagtgtgagtaaatgggaaattgatatctttaaggcactagatatggtaataaatatattagattactagaagagaaaaaatacttgaatagtagccaagaaaggattccaattacttacaaactacagtgactaacttctttcaattctaaaatcccctattttaatttttctaagtttctgagaaatgggcattttagtattactccttaaaaacttttttactgaataaaataattttcatgaaattacaaaaacataggatctgctcatattgatagtgtgtttgacttaccactcactgtattgtgtctcacttagattaccagcaaaaatattactcacatctaatgatatttctgggtatcctataaatgaaccctgagaggtttcctggagagtcttgtaatgcttcctagctacccctgtatatattctataaaatatagccatgtaaagtatgaagacaatctgttactgtcttcctggcagggctggtcaactggccatcagacactgtggttgcatctggttgtcccctgcttcctactgctccattgtcccactttgggtgtctccccctcctccctgtgctggtgctgccctttcataggccttctctcaataactggatctcaccaggctcctttctgcattcctagctttgtacttgctgtgtgacctggcaggagtgcttctcctgggttctttgcagatctggtttctccttctcaaatgacaccaccttagaaagccctttcctgagcatactgtgcaactcagagctccctgttagtctctatcacagaccccttacttacttcctttttagcactcctcaaacaccttcccccaactaaaacataaaactctatgaggatagggacattgtggacactcacatattaataagtgattgaaacatgaatgcatttttaaaaagatcagtaccaacatcctaaaggctcgtggagaagggcatttgagctgactttgaaaagtagaatgtgaagatagcagggtgtaggaaaacaagagttttagaagagagaggcttgtgtcaaggtgatcttataaaaaaaaaaaagctttggtatgaaggcaggcatgtgcatgtctttactgggctttgtggagaaaatagagataaagaataaactttggggaaccaggaaaaccttttatctaggaaagggacatgatcaaaatggcaccagtgtggcatctagtggatgagttgaaggttcaggaattgctaagaagtaaaagcatccacaccctacttcctgtcttgctgacatatatatatatttggcctcatcagtagcaaagctcattaatactccaggatgatacagaatagaaatacaaactggaattgtttgtttaatctatatttatgcattcacaaatatttactgatccctgctccatgtcagtcattgtacctctgatccatttgggcttgtaaatctgtgtatgtgatacttggagatgtttttgcatacctaaaatgagacaccacttaagagatttagctgttgatactcgaaccagtgaagacaaagctggcaaatacctccctaaataggaaggatatgtatttaatttggaaaatgtcaatttatttgttaccctacacagtaagaattagatatctagaaacaactacaggtatgaaatataactgttgaaatgtgtgcttcttttaagaaactccaagagctacgtggaagcatgtgttgttttcttgtcagttttccttctcatatgacatttgctcctaaaatacccaattttttttctgcccagacctacacacccaacccactttagctgtaccatccttagattactatgtcacaaattttaccttgttttgaaactgaagtacagtggctgattttgctatttttgcatttatttgcaaagctgaattctagtaattaccagcaaagataatcgttttgcacaaaaagaggtatatttctatcttgaaactaggttatattgttaatgccacagaaaaggaaatggctttttcagaatattagcgtttgtagctcttgcttattgatagggaaaagttagttgccatagtgatctaacagcctctggagggaatgcagtcatggccttaagcatccggcaacccacccagttgagagagcccctctgaaaaggatttccttccatggaaattgagtttctaaaataaaaagagtttattttagcttagatttgcttataggtttgttttgcacttttacctactggaattaaaggaaaaacatttataataaagacagcatatatttcttcagggatgacattaaataatagatttttgtgttaaccattccataaatgtgctctcagacacacaaaatgacctttatacttttattcttgtgagctatggagcttaaaagcaaaccacttcaaccagatgttgatccaataaatttatcaatatttggggtttttagagtttcagtatatattcttaggtagagggaactttcatggcccatcaaaatctgctcaagctgtgctgggtgaaacagcactcatctataatactcatgtaacatgagccaatctgcagtcggttgttctgaattctacatcactcacagcgcaggttgatgtgtgaacactgtatttacaggaccaaaactgcacatttgctctgcagctgtgtttaacagttatcagtttggcacacagcatgactgctttggagggagaatagacacttctcatcccttttggcatttatgaagtaaccaaagtacctactgctgaagtgattcacttgagcttaattagatttgctacataattagcatttgaagaaacctaaagaaaatccttgggggttggttatttgttatgtcaattgtaagcatgctcatttgggggggactaggaattgaaaatgatgaaatttaatgcaccataaacccagatgtattatatgcatatataattttttgaagagtttttaaaagctgtgcttcgcagggatgactgaaatgcttgtctcagacaactgagacctgtgcaaggggattgatccatcagcatgtgcccatgtctgcttgatggcgcttatgtgtgtacaactagctttacacctctcatgagagcccacagctctttaataaacaccccagtgccagccgtgagggctgtgccaataaccaccacttgaagctggagagtgcagtctgagacagtgagatcctatactgcacttgtatttacattttaaggttaatttaattgcaatggcttgttctggtatgtgttgctttaattgcaaagaaaaaaaatgaatttaattttatactcgagacatttctttaaatactcctgaagtttgttctttagtattagagttctacaaagtgaattaactgtggagaatagctgtaaaatactgagaggagaggttaaattttatattccagtttaagttaaggctaggataaaacttgtaaactatgtttatgtaaaatattttctaatctgtcaaaaagttgtcacattttaatcaaattacttagttacctaaatttgtctagccataaataaggaaataaatgagagggaacaagtttaatttattgatgaagcactctgatgattttttttacccttatagtaaaaaaaaaaaaaaaacaccttcaaacttacatcctaccatatgttcaccatcaaatctcaagtcagaatcaggttcaaatcagaattcaaaaccagttttagaactcaagtggcagctcatgccctgcatgcaggcaaacggctaggaattaatcagaaagttccacccatgtccatccttcctcttacttgctcatcttcccagcaagcactaaaaagaaaaaaaaaaaaagtacaaattcgtacggaacctactgtaactctgattaaagagatcctgtattccccaatgaccgaccccctagctcccccaaaaaggaattaaacggctaagctttttataaatgtttttaaaatccttattggacttgacataaacatgcagataattctactagtctctttttcataggtacaataatagcactaagtacagaattccccttgtatccaagcaagacttttacgaaaacttaaacctgaagtcttatgcagtgcacctaaaattaaccaggagccttggtgcatataccagcaaatgttgtacacctgtgtgatagtggtcacctcacttaacctctcccagcttcagtttcttgtctttactactacataaagttgttgaaaggattaaaggagactatataaacagctatttttatttatgattaaataatatctgtgtggttactatttagtctgggtaactaaatagctgggtttttttgttctttgtacacatgcacatattccttttttaaaacaggcatatgggcaaatacattttttttctatatgcctccatgttgtttctctggatttccgccaggatgggatgtgccaattatgcacggaattgtttgcgtgtccatgggtgcttatataagtcattatctttggtgtatgacaaatacacaaactcctgtatctctagtagcctgtaattcctaattgagggacatgattgaatttatgtagtttagccccaagtaagtagataaaaattattaagtaaatgccctggttcatctaaacaaaatatgtgactaatagctttttatatgaactatatacatttagtttacctaagtttattaataaatagtatctctgggcatttttaattttatattttatacttaactatgaaagtatccagaaccagattccagtcactaactacctcttcattaatggatcaatggttttatcagatttattagaaatttgtctatactgagcatgtaatatgtactttgtgaaaataggtataaaactgggctcatcttatcagcataccatttacccaattatgggagtaaaaaaggaggcatgtgtatttttcccctaattctgaaatgtctcccagttcttgaaatttgaatgtgaaaatgtgtgcatgcaaattaagacattcaatctgaaagacttctttgtataaaatactaaccaaatttaaagttgaaccatagggtaaatatagtagaaaagtatattttgaattctgaattttatttccattggatacaaacaataattacaattgctagatgtgttttaatgaatagtttgaactcatcatgctagcaaaaatcatctgcatataaataatagggcaatttcaagcaattttttcttacttaggtcagatattcctgccagaaacttgtttgctttgttaatttgttcaattattaaactttgagagtacaaagataaatttactaatggggttcaattaacaaatttctgattacatttccctaatgatgatagtatagaacatttatttctgctgtgctttattagtaaaattgcagtgatctggtgactggaattaaactgctgaaaaatgacttggtctgatttattcactgagcaaaaccaagctttaaaggctgtgttgctatggcacccaagattaactgttaaaaaaaaaaaaaagtttaattttagtaaaaacattggtacatctcttttggcattgtgtagataaaaatagattcccccctcccccttttcttgtcttttttatgtttagcaagtcctttgcattcttttaaacatacactaaaagaaatttagcatatttaaagagaagggaaaaagcagtaaaataaaactgttttatcaaaagattacaatttgtaaaatagcaaatatttcagtcatcattttttatatgtatatatatatactttttattttgtctaatttaatcctttcaaaaactgtctggcttctcatactttttagaaagatggtgccagagagggagaaatcactctattctggtagtttcgttttgtaattagtcttcaaacttaaaaacaggttgcaaaattgggacagtaacaagttttaggagaaatcttaatgtagctctaatctttcaaattctaaaagaatatgttttctgtttcgtgagacaaaagaattgtctggttgctttagccaggattgatttctgtcttcagaacaccatttggtggtgttaagactgctagatgaagaattttgtgggaaaaaaaaaaaaaaaagaagaaaaattgaatgctttgtatgatcatcaaaagccacttttcaggagtattttacatttcttggtgccaagcaaatcagaaatcctaccttacagagagcgatttgttcatgagatgacccagtgctgcaagtcgcttatgtttatcattatgcttccacattctaaggaaattccactttcaaacgttgccgtcagtgctttcttctataggaagaatttgaactataaaatttgagaagcttcagcgtctgtggaaatttgagagcattgccttttttcctctttattgaatgtaaagtgttttaacaaaagcatggtagcccagtacattttaaatgtcaaaacttgcacatagtgtatctcataaagaatttaaattttagactttgaacttttaaagcctcaaacatctttagaggctgactacagcaaataaacagaatgttttgcagagagatttagtgaagaaaatttttttttgccgttgtttctcacagtgctctgcaggtgaaaatggtgaggaaactttgatagttcaagactatgcaggggagaatttgaaagcagaaacaagcttttacagattttacctggaaaaacaaagtggtttatatgaggtgctagttcttacctttatgattgctaatttagattttataaaaattgaaatgagttaatattttaaaatatttaagtatggtctctggacaacaataagcacagtgtacttttttaaaaagtgactttatgtaagattataaattacagaaatgagttgtcacttccctgttgttacttatttctgattttaaaatagcaaaatttataaagctatagttttgagaaaatagtaattcatattcttaaaattgttataatctctaaattaatacataaattattgatttaatgttaaattttgattttaaaatttatttcagtttctataggtaatatattgaggttctgacaattttatattaatgtatgattttattctgacacagctgttgaatttgaactactaattatttctaagaatttgttaataccattctccaactttgttttaggcagctagattgtatccagggaaacccatttagatcagaaataacatttcgttctaacttcaaaaaataagcatccactttaaaaatggaatctgaatttaaataaaaatcctaatttaggattcagttccattctttaactagcggaaagaaatcttagcaaaaaaaaccaaaaaaacaaaaaaaaaccaaatttaccagattgccagtaatttgcattaaggaggaagagatggatttttttttaagtcagcaggcattgaagatagttcagtgaagttaagtaatagagatctcagattttaatttagtcaagattatgattttacatagaagcactgttgaaataggcttgataataatattttaagtgttatacaaatctggatgaaattatattatttactgtcttactcattggttcaactgtgttttaaaagtgagagaccttatatcaatgagtgtttgttctgtgcatctcatgtgcatggtgttaacaaaataaaataagcatacttctaacatttgggggagcatcctattagtttgggggtaggttagggactctgctttccaaataattaatttgatagatccatgctcttgaaaaattgggtacatactatttttaaactttatttttcaaacatgatatgtattgtttaaagcattagcttaaatgaaaaataatattttacattcgtaaagttctgtttatttaattcagtaatgaaattaatttggagttgttggcatactgccttcacaggtttctgtgactcatttgctgagaaagtgtgattcaagagaccagaatcatttttttctcatttgctaaaactcatgttttgactatgggcaaatgttcatggcagatttaaaacaaatttaaagtaaatattctgtgataatatttggaagctgagtgatgtctagccttacataactaggacaaatataaatctgtgagttcacggacttcaaaagtatcaactatacatcattttagaatactggttttgtttttctcatattcttagagtttaactcttatactactaattatgacctctagaaggtaattgcatttagaagcagaatatctgctgttttattaatttaataattaaggactaaatggtgttccaatttaggtttaaaagtaagcacattcacacagcatttaaaactatttcttaatgtttttttcctagagaagaaatgatagctccatgatcgctatatgttctgttcaatactcattatatttataatttatattacatatatatttatccattatatttataatttagtcctgtccaaataaaatatattctcatagttaagtgtgttgtggtagtataatgattacatgaaataacctggaccttgctgtttgcaaagtaatttaaatgtttattttctgagttgctacttggaaattaagttgtggagtgatgtttctcattggtccaaggagcaacataaaatcctgatttatcagataatcctacaggaaacgtatgcctgttttgacttatgatatgtttcttagtacaatgtcctgcttttctggctttccattaaatgtttagaaaaattagttaatagttttgcaggaaaagaaaggaaatttatcagtctataccagctatataagaagtaggaacatatataaaagacctataattttccgatctcactttgaacttttcttcacagttttccaactcaagatggtatatagtcttgcacaatgggctgtagccaactttccgtcagaagaactgagtaaaaattattccaaaattgttcttagaaataaatctgagcctggaattgtcttgcattaaaaaacaaaaagcaaatgattgctttaaaagcacaccaaatgatattggatggtctttattcttgactctgttttttaaagtgtgtatacgttcattacatccagttgtctattgggcttttttactctaacttttcggaagttgactgacaggccacttttctatagtgggaaataggcaccttgtgtgcgcggagggatttccagcccccgaccccggaaccagcaattagcgtttaggcgtcctgcaccccaccagggggcagcaccggacactgcctttcctagaggcctgagtgcatttaaggctttctggcagtgctctccacccctcttcctcatacaggccttacgtatttttggtattttcttacacattttaggcttagtaagtgtttaataaatgttagctgtttaggcattgtgctatacggatgctacttttcaggtttgaccgttctgtgtacctgaattttgtctttaatgataatttgttctattatttaaaataccttgtgcttattataaatatgggattcctttaacttgtaaaatctagcaattattgagcactatgacatgtcaggcatgaaaccaggtactttttatatgctactgcagaatctaagtagacatagaggcaagataacaatagagtcataaaacaatatgaaactgcaataatggggaattgtaatacttctattttgatgttgaataaacagtataaacctcggggaggttaagtcacaatggaacaaagatcccttcagatagaattccaaattccgtgctgtatcaattatattatgaaaccttgccataaaaaaaaaaattgttgaggatgagcgaagccacgatgtgtaatgcctgagacagaggtttcagtgatgtaactccagtgacactgtgacaaggagaattagggattgacatacttaaaacttgaatggagaaatagggttagatattgagagatcccaaggaaacctgtgaaaaccttaatatatgtgtttttatggacacataatatgtaacatattacattcatcaaaacatgggaataaattgacgtactcttaatttttaaaagccccataaatatattttacttaaaaccgtaatggatcttattcttttaatttgtgcttgtcctctcttacctgctagaaaatttaaaggttgtctgtccttcctaattttaacaagatacttcattttccaaaaatgaaacaagacaaaaaggtaaatttgttttgttttgttacagaaaatagtcaaatgaagatattttgcctgtgtctgtgactttaatgatttggaattgttatttcacattgtttgctttcttttctggctataatgtgcatagcaatccagatggctaatatataaacaattggagttatgcttattggaatcatttagtgtggcttaggaggttcccactacccaggaccatctgttcattgctctgtgtattaccttcatgatcaagtttgtgttttcagctccttcacatatcttagcctacacctttctttatatgtgaaagaggcttctaagactgaacttaactcatatggccctcaaggctatattgtcaaaccttgataatccaagcctgccttccacattaccattcttctttattcctaattcaattttttcccttatcattgctattctcaatagtagggtcttaaaatttgcagaagagtgactaagaaaatgggctttgtagtcaggttcgaatcttacttggctgtgtatgtagcgatttgatcttgggcaacctcctttatcttggtttcctcacctgtgaaatggagtataatactgacttcatggatttgttaagatggttaaattagataaaatataactcatttagcccatgcctggtttattattaacataatttagaatgaaaattctcctgttgcaaaaaggcatattcagaagtaaattcaaatactatattctaaaatttcacagcgtcttttggaagaaatagctacttttctttaagcacctgtcatatgtgctttcacattgccaacagaatatatgtaggcggtactaaattgttgttttggggttcattttcagtccttcttactggatcctgggtgcaactttagaccccaagtagctagagaaaagtttctctaggtgcctgtcgtctctggttacatgttacactataatctgctttggagcctcacagccacatatgttattgttccacgtgaactgagccagcttacatacacagctctgtggggagaaagaccataaacgaacactccccgtttctagcccatattctgcataatacatgtaagtctctcaacagccctgtaggctatgccattacttaattcccaatttatgtggcttactttttctgaatgaaaagtcatcaaatatggtttttaagttatggaacagaagaatatgattaatctgaattgtcatgaaaattcagggcacatggttgctatggttatggcgtcatgtatttataatggagagatactttgtcttcattaatctacaaacttgccagtgggattcggtattttttttctgtgtgtgtgtgtgtgtttgtgtgtgtgtgtacatacgtacgtacgtacatgtatacagcttctgcatgaaaacactgaggctgaacaaggtgttctgttttggtggtagtgcagagaaacatactcacacataaattatttatatgtgaaccaattcagtgagaagtaagtacagctgcttaattgacctaagggtcttatttccaactgcttaaaaataagtgtaaagtgaagttcatggaagaaataacttaaggctctttaatatacttttgttggtgaagagaatttcaagctgtttcagtcagttagcatatattcttaaaaagactgatatcctattcgtagtcttctcttatatatccttgaattatcttccatgatttttatattttatatacttataatagcgtattataacaacttaatgctacataatttacagtaatcgtttccaaattaaggaagccctatgtgtaaaatcacaaatttatgtaacataacacaggaacttttattcatataagaaaatcattattcactttactgttttcctttatttcagcatcatttattacaaaattaatactgttttcgaaaaaccaaaacaatatattataaagcacaacgtggagtcttctctcacctccttgtcattcccagcctcaaagggtaaccactgtttacagttcaagtgtgtcttcacagcagatgtttttctatgctcgtgcagacatatagatgtattcctggaaagagtgatgcttgcattcttgaggagttaggagcattgctatttgaaaaaataaaaatccagtttgatgatgttagtcattatgctgaaaggagtgattttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgtattaaaagtcctaaagttgttcgtggagatttccagttgctagggaataccaacacttatttggtgtttgatattgtaaatcatgatagttattggggccaaagggaggtctgtaaatgtccagtaggttctctttggagctaatttgtgctgtttgcattttctttctgccccaatacacttgtcactggaagaaatcacacagggggtagggataaagcatgaggtatcatgattccttcatgtaaaaattttgctcaaattaaaatgtgaacatagtataatatgtaaaaaaaactggacctccttaaatcctttataaagcaaggcaatgtgtaaacacatgaataaatatgaaggttttattttaagtaatagctgtgaatgttaaaagtaatattattttccttagaatagtttaatcacatatcccttttaaattttttaagcctttaaacgttttattttcagtctgggcttggggactcacacctgtaatcctagcagtttgggaggctgaggctaggggatcacttgagcccaggagtttgagaccagcctgggcaacataagaagacctcatttctgaaaaaaaaaaaaaaaaaaaaaaagaaagggaagaaaggggaaggaagggaaggaaagggaagaaaaaaacgaaaagaaaaggaacaaaggaaggcgtcggtgatgtgcacaagtggtcacagctacttggtagtctgaggtgggattgcttgagtctggaagatcgaggttgcagtgagccgtgtttgcaccactgcacttcagcctgggcgagagagtgagaccctatttcaaaataaattcaaatttgaatattttacttgagtaacattttttttctcctgaaaataattttctacagtgttctactgtggttgaggttttcatgtttaaatcagatctctagcctcatgggactcatagtctctcatggaagacagataattgggcaactacaatggattatgccgagttcggtgctttgggagctcagagcacaagccccttcctcatctgccctgtagggctggggaggtgctgtcaaggaaggcttcccagcgggagtgattcctcaggtaataacctgagatttgtacacacatcagtcaggcaaagagctgtggacttggggtgtgagtggccagagacccagcattatctgcaaaagctagactatgagagagatgagaacacagttaagtaactgatagaagttcagtctggctggggcatggaggaattacaaacatttattatgaaagtaatacatgtgcattgtataaaatgtgagaaaaacagaaaatgagaaggtatatattattgccagtttcatgctgcagagttaactactgtgaacatttgttgcatttttataattctttccatttatattcgtagaacagcgtatttgatattatcccagtttggcttagacaatagatatatatacaggtataaaatgcatatgcatacatgaaaacacataataaaactgggatcatgcgaacatgctgttacctgcttttttcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 360 - DNA, 239644 bp, Homo sapiens; identical to SEQ ID NO: 359

SEQ ID NO: 361 - DNA, 148651 bp, Homo sapiens
agctcagtgtgtggtgagcggcggcggcgcggccgggccggggagcgggcgcggcccggcggcctcagcatggaggacggcttctccagctacagcagcctgtacgacacgtcctcgctgctccagttctgcaacggtgaggggcggccgcgcggggccggggcggcgagcggctggtggcgggcggcggcgacggcgacggcggggaccaagccgaggggccgaggcccggcggccgcgggcgaggccgcgcaaagttgttgcggaggggcgcgcggtccccgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtttggaaatgactggatgaagaactcgggaaacaaatcctttaataacaaaaccctcctgcgaggatgcacgcagtgtttggacccccagaacccattcaggtctactttaatgaaatcatcacaatttaatacaatctagagctttttaaatggaaagccaaagtggacctggcctcagtgttgcttcttattttgtttatgggataatggattcttttttctttttttgtttttgcaattttacaggaaggaaacattcatatccaccaatatggcatctttttaaaaatatgaaatcctacatgcttgaaagatttcagtctcattggcagggttgaaaaagattttcatagcacactgaatattttatcagaacatgatgtgtgataattcacgcacaaaagttaaccacacttttttttttttttacatgttggatttattgctccatcaaagggccccaaaagtttgttaatgggaaaaaaaaatgtgtatttgatagaatttgcttaagtgcagtcggaataattttgaattctagaccctttgacaactggagcaatttattttgctattgtattgtgatttagggaaagttttcttgttattcgacacctgtttgtcactgtagcagtaaagagtaatgagtgtgttgattcatcctctgtagtggtattttttatctctggtgaaatttatcatcttgttcatggtagaatgtatactctgatagcttttgcagcttatactttacatctgaaccatttgtgggccttcatgaatttagtaattccctcttcagtggaattaaagaaagtttctgctttttctctgaatttaacgccagtttccaagagcagaacacctgtgtttttgagcctcagaaggtgttgagggcaggtagaatgtatttggtatgctggtggtccctggaatactttatagtatagagtcatgggaacggttttgctctccagtaggttaaatagattcctcaattaacattttgaataggttccttaattgacttataatcaatcatatttgaattattgtttttgatctaaaaagtagttatatgcttatggtagaattctccctatgcttagttggaaagatatgtggctgaaatttgtattaaatgactttgaggcatcaggtcttacaaatttaatctgtgggcgtattattgacagcttgatttgcgatatgaaaatgagcctagatatttttattggagcagttgtttggggcctggtcatactgttcctaaatagcagtttagtcatgaagttgacctacacgtctgttcatgaatgttttcgttttctgcattttccttttaattgccagcctagagatattggcatggtattttactggtggtgatgtccagaagaaagtaaaaaccaactcttatattttgtagaagtattggtttaaagaaaaaccaccttaactagaatcaaacaataagatcactttataactattgaattacttttctcaaaaagttctcagctctgtatttgttattttttttttaggttgtctaatgaataaagtttaaagcaagagtggcctatggggcagaagtcaatgttaactggtgatgtcttaggcaacagatgttttgatgtgaaacattttaagaggctttcattaagtgaagatataaatgaatacaagtcagttaattactatgatgattcaattaaagcagtggatcacagaaatgccatttcactaggaactaaattaaacatttggatatttcattagctacattggcaaacaattttttctttttaaatgagagacttacattacaatggcaagacagcagcataatacatgaactcatacattttcatatgttcagtatgcgtcatgctgttaatagtgacagaaactaaaaaatcatggttacagctttagaaaatataattcacacatattatttggatgactgtcatagttaatttccttctggtcaaataaagacaagatcaagatatgcgaagttgaggcgggaggattacttgcagccaagagtttgagagcagcctgggcaacatagcaagacccccctctacaaaaaatttttaaaagttggctgggcatggtggcttgaacctgtaatcctagctactcaggaggctgagatgggaggattgattgagcccagaagtttgaagctgcagtgagctatgactgtgccactgtactacagcctgggtgacaaagtgagaccctgtctcagagagagagagagagagagagagagagagagagagagagagagaagataatgtgtaaatgagaagggagaaagagaaaagtttgttctaatgaatgaaatttctgtcttctcttatacttctttcttggtgtctctcctcataatttgtagtggacattaaatgcaaagttaggcagtatctagcctcctgaaaaggctcatcctcatctttcaggaactgtctttctcatttaagcagaaaatgtgtgcattgttttcttcagagtatttgaaatctgtaaagtgagctagaaatcacaagcttttttttttttttttctttgagccacaccttgctctgtgacccaggttggagtgcagtggcatgatcacagctcactgcagactcaaactcctggggctcaagcagtcctacctcagtctctcaagtagctgggactacaggtgcgtgctatcatgcccagctcacaaacttcttttaatgctgggaaaaaaaaaaaacctgaagtgttttaaaaagtgaacagtagctatcctttataagacaatttatgatttgggaaataactccatattttcttcgaggcctcattttgaagtaggtggtgttaccatccttcctttgtgcctgagaaaacggaggctcgaagagatttggcaactttatcaggccacagaactaggaagggcttggataccagtctaaatctttgtgtgtgtatgtgtgtgtgtgtgtgtgtgtgtgtgtgagagagtaatagctttattgaaatatttacataccataaaaatgtgtttttaaagtgtaccattaagtgcgtgtagtatattcacagaattgtccagttgttaccactctctgattttagaacctttgcattactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgttttaaggttcatccatgttgtagcctgtgtcatcatgccattcctttttatggccaaattatattcccttgtggagagataccacactgtttaaatctgttacttgttgatgggttatttgggttatttccactttttgactcttatcaataatgctactatgggcactcacatgcacatttttgtgtggacctatgttttcatttctcttgggcagatatctaggagcagaattgctaggtcatatggtaactctgggcttaacatttttaggaaccagtcttaactttttgaaacctaaatattaagcttgttttattatacatttttgataaaagaataagtaattaaggaaatggatgaaagagggaaagaagtgggagcaagtaacaaaatgttgctcatgcatttccatgagtcctttggatcctttgatcaatcacagctcaccaaaacgagtcagtgcacaactgcacgtggttgccacaggttataagaatctcagtgcctgaacggacctggcaagtaatctcatctcatggtttactttcttaagcctttgagctgtttcttcaaagtaaaggttacccaggaacccaatggtaaagcagatagatacagagctggcatagctgacagggagtggggagaggatggtgctttggccctcctctccttcccccacccctccagcttgaaatctctgccctgtgggggaagctggaaaggctgttcaaagctagaaaggctgttcaacctgtgcatgagcattttcaagagactggaaagtaactacctctccaggcaatccattttttctccagacagttcagactgtcagttcctacaagcagtgaaaaatcagccgaagttgtgttccttgggtccgtagagaataggtttaatatcttatccatatattaggtcatcacatgtttgaagacaatgattatagttctttctcacatcttctagctcttaagacgtaattttagacccttaatcatcctggttgcttcatctacacctgtttccttttgtctgtatttctttcttaacttgatacaactgaatgtggtattccaggcatgttttctacacaaagaagattagaattggatatgtcacctcccttattccaaagtctatactttttttttttttttttcgagacagagtctcactctgtcgcccaggctggagtgcagtggtgcaatcttgcctcactaaaacctccgccccctaggttcaagcagttctcctgcctcagcctccagagtagctggaattacaggcgtgtgccaccagcctggctaatttttgtatttttagtagaaatggggtttcaccatgttggccaggctggtctcgaagtcatgacctcaggtgatctacccttctcagcctcccaaagtgctaggattataggcatgagccactgtacctggcctatacttctaataatgcagcctaaggttatatagactccatttcttgtcacatcacattattaccttttactgattttcaagtaaaattcttgtgtactttacatgtactatggctaaatcttttcttaaatttaattaccttttttttttgagggtaagtttcctcgaacaggcagagccctatcagattacaacaccattataatctgtgttgtaatgctataaataatcccagcacttactaagatatttcagcattatagtaacattgaaattgaccattgccttacagggttgtgattgtggttaatagccttttttcttcttgccttggaaggtgtcatgagagaattatcagatgccctctaaggcctgactggagcgtatctgccatgtcccagatctggcctggcttcttctcctgcaggtgctacttgttagtaactacagcgggtcgagtccatgggacctgcccagtcaaattttgaaatcactataataatcctttgagcgactgaagtttattttttctagttttgcaatggaatgttgttttaatttctaaacatttatattttggaaattaacaataatttatttaataatcttaaacatcttttgacatctctaatactgatgacattctcttaactatgattacagcaggattttcaagttgacacctcgatggttataaacaagtagttggatttaaaaggaacacctgtaaggaaattatccaaactcaacgctccgaagtattttcaggcctcttttgcattctcatgcagtgacagaagactgactgaggcattctgtgatagcaaaatcggaggaaaacgctttcatggaaaagtgcaaagcaaaagcacccacgctaagcgagaatttctaattagtatacttggtgctccagccaggaaggaacttatagccaaaccacaaccatttatcacattataaacaaacccacgcattttggtggaaaaaaatcacaaaactgtgcttaaaaagtaaccattaattggttattgtccatttctgggatagtgtaaaccttttcacatattctcttaaaaaacattttagttgagtggaggttggataagagaggagaaataacatctttgtttctagtgttacagcttgttcatgctataaaactagtagcgtgaaaaccttcatcatggataacattgaaaacggaacatgaaagcattgctctctctagtaagacagtctctccaaggacttaaaatcagtggcattttgtactccttacaaaaatttctttcaggaacaactattcatccttaaaattttatcaagctcattaatagagggtttctagtattagcaaaatttttaaacaccttcagaagcattactaattacaaacaaaaagtgtgctgtaaactctaaaagctgtataattattattgataccacccgtcacccccagcttcatgtttttctcactagacgtttggcacatagatttcatttctgctgaaggctgcacattcattttaatctggcccaggactgggggtgtgcgaaggtgtcagcaggagcaagtgcatactctctttggtttactttttaagaaatacctcttcagaagagtttttctttctttaaaggacttgttttttttttaagtttaattaattatttattttttatttagagtcagggtctcactctgttgcccaggttggagtgcagtggtgtgatcatggctcactgacctcgaacccttggactctagcaatcctcacacctcagcctcccgagtagctgggactataggcatgcgccaccacacctggctaaattttaaaaaaattttttagagatgcagtctttctttgttgctcaggctggtcttgaactctcctcaagagatcctcctgccttggcttctcaaaatgctgagattaagcatgagcccctgcacccagctaatttttaagattcagtttagttagatacatttccatttttgtttactctaaggttctacctttactggcaaatactgttggcggggaaaaccattttttgcagagtactctcagttgtgtgttaaaatgcagtcatttatttattctgccagctttctggaaaatatttaaactctctatctttaataaaccatccccacagtgtaggggcaggttcgacctatagacttgggtgatgcctgagggcacttactccaagcccagggcctgcccgaggtagggagtcttacaggagaccttcccacctgccgaggccctgctgtcagagggaggggaagcagaggtgactggccccctgaggccagcggccagatccatgcatttatcatggtgtggtccaggactggtggtacccttcactctgcaaagcccctgtaagggagacccaccgtcctggactgcagattcttcccacaaataacctttgaaggacaatgggcagcccacagttaaagataacaaggatagaaatggttaggcgaatattcatggagagacttgagtccgtttggcaaatcgggctgatttccagtgaatacctacagtgggcgtaggacaattaaacatgtcaaaaatgtagtctcccctgtaaacattagattctcctagtaattggccgggcacggtggctcatgcctgtaatcccagcactttgggaggccgaggtgggcggatcatgaggtcaggagatcgagaccatcctggctaacacggtgaaaccccgtctctactaaaaataccaaaaattagccgggcgtggtggcgggcgcctgtagtcccagctactcgggaggctgaggcaggagaatggcgtgaacccgggaggcagagcttgcagtgagccaagatcgtgccactgcactccagcctgggccacagagcgagactccgtctcaaaaaaaaaaaaaagaaattctcctagtaatcattttagactcttctacccactgccccatatctcagttggctcagtggattctgcaccccaaacgtctcatcatccatcccttcctccctggctcgggccctcatcagttctcatctaggctagggttgggtttggttttggcagcagacctaaagcagtcttcctaactctagtcttccatccgttcctttaaacaagcactcaagtactcacagcgtccattattacactgttttaggggttccagcgaaatgcgaggatgacatggtccttagccttaggaagcctaatttgtttctcaggagctaaacatccagtgttattttcacactcacttcatgacaacagtgataggttgttctaagaagtgtaaggaacaatggtagggtattgcagcactggggggcatgtatcagggcgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttgttttaaaagatcactctgcttccagggggagggcaggtgggaagggcagtccagggtggaggtaggagggtagaggtggggggccatggcagtaacccagggagaggcaatggtgattcaccctgggcggggtgttgggagcaagacgcaggagatacttagtgggtaacatcctgtatttacattaagagtggggagagggcagaatcaaggctgacgcccaggtctctgatgcctgcaactggagatggcaggacaggccagggggcctgtgcagagatggcagtccaggccacgggggaggtggtttgggcttgtggggtaggaggacatatgggatacaagctgaggtgctgagcaggctgtcggtgaaggtctggagcccgggagatggctgggctggacataacatttgcgagccatcagcatccagatagtaatgggatccatgggcaccgatgagctcacccaggggaaattagacatttcgaatgtgcctcctgcaagacagatccaggcaaaatggcctcctgtttaaaagctgacagcagccctccctcccactttagcacccagggccccacttatcttcatccctgagtgcccccaggtgcccttccttcgtcggtggctatgtggtatttagtataaacctctgtcatcatgattatcccagaggcctgtcacggaggtttattttcagtctcccattagatataagctcctctgggcagactttcctgggatcgtctctgtgtcttttgcacctcagcagtgcctggcacgtggtgagtttcctggtgaaaggtggttgaatagattcagggtccatcttatttatcttatagcacctcctcaaacacacgcaccaggcgccaccaggcaccatgccacacatgtgacaggtgcatgccaaataaagcacgcccaccgcttccctgtgtgcttgaaacaacgtgtatcaatgtgtatagtatataccacatgtgcatataactgtatgtatacctgcgtatctacgtgcattatacacacatgcacacatgtgacattgaactctacccttcagcaaagaactggtagacttagacattcagaagagaaggctttccagacgagggaccttattggtagaacccagaaacatatgaatgcaggcccaggagactggcttagtacagagacaaaacttgccaccacagttgctgctgaatgcctctcgctagacaccgcttcactggaatcaataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgcagcattactgtgcactttagccccagctgtcttcatcacaaacacttgaaaatccttaggaatagaacttagtgatgatgctttatctactattgagtcgcttatgcttaccaatcctgtatgcaaaatgtggcagccgctcccaggggactgtatggagctataataaagataatgatctgttagctcggcttcaccgaattagtcctttagaaagtaattaagcaggattgcccacactccactgctcccaaagactgaaatctggcttggtgtgtcatttctttgccttccttgaaaatggccttttattgagttgatataatttaattatataaaaatacgtgttcagattgcatcttgtacttaattatatcttacgccacggagttatttcccagccagagcttgtgctgttagaaggtggggtccatgtctcattcatgcgtgtatgtgtgtgtttaggtgcaggagaggaggggagagaaatgctggctttaaagagtgctcaccaagcatcaggtgttgggctgagcatttttaatgtattcttttgtttaattctcacaacacccttttgaagtgggtcctattattgtctccattttgaccgacaaggaaacagaggcccaaaactttgagtaacttgttcaagattgcctggccagtgtgtttcagagctggggtttgaagccaagcattctggctccactgtccatggtatactaagtactcagttatgctcgatgagtgaatgatgggaaaaaagatgggacagctatagacctgaaagggacttaggagattgttctggtctgcccttgcctgtaggagaggccacacatggtttacaagtgcagagcaaaggcctttcccttggattattggaggagtctctgaacagatttccttgtcttcacctgtttttcttcaaatcctacttcttcagcacttttaaaaatggaaacctcatttatctctgaattgcccagcatcccccggaagttccccatgactcttggggttcagggccgattctgggaaccacttgccacctgcttccctgaccctttcctcccagggccctggatgcagccaccctggacttctggtagcttctgaaggtgccaggctgttgtgtacaggattccacatgctgagcgcccttgccttccctgcagcgtcccttcctaccccttcttcacggagccgctcccttgtccttcagaaccctgctcccatgccacgggaaacctcagggcaggtagatgtaggcgcagctcactgggtgccccttaggccccaggccacgtgtctcagggcatagccagctccacttaaccgaccagaccaggaggacctgtaggatgtcattctggctcatgtgactcagtgggctctcagtactagtttgttgaacaaaagagttcagagtggaaatattaaatggtactttgagtcgtgcctacttaggacattttaacttttctctgttagcagcccgcaccaactgctgtgacttagtgtttgtgaaactcttccgtctttctgttaacagttgtagttctttcagtgtttcatcagcagccatattctatttacttattctctttcttttcttcttcttcttttttaaatcttttgaggtagggctcagtctgttgcccaggctggagcgcagtgatatgagctgggctcactgcagcctcgacctccccagcccaagcagtcctctagcatcagcctcctaagtagctgggactataggcacatgccaccgtgcccagctaatttttttatttttttgtggaaatggggtctcgatttgttcctcaagctggttttgaactcctgggctgaagtgatcctcctgcctcaacttcccaaagtgttgggattacagccatgagccactacacccagccctagaaccctttttttttcaaaaaaaaatttaatcatggtaaaatacatataaaatttagcatcttacacatttttaagtgtacagttcatggcgctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacaatagtttcatgaagttacagaatcctaaactgaatgtttaactaaaaggttcaaagccctgggcaagaagtgggataattacctgcacatttgaggctgtcagaacgcctgaagatgtgtcaccggatcacacccacgtgcattacaagcagccctgctcagcctcctgtgtaaagttttggtatccgatctccagaatcttttttttttttttttttttttttgagacattcttgttgcccaggctggagtgcagtggcgttaatctcggctcaccgcaacctctgcctcccgggttcaagcgattctcctacttcagcctcccgagtagctgggattacaggcatgctccaccacacccagctaattttgtatttttagtagagatgaggtttctccatgttggtcaggctggtctcgaactcccaacctcaggtgatctgcccaccttggcctcccaaaatgctgggattataggcatgagccactgcgcctggccagtctctggaatctctaatggaaagtgtgctccttcccccaagcaagagccagtacaagaccactctcaagaagggtagtgccaagtatgaggagacagggcatggattcagagctgcccttcacacccaagcacagcaacactggctgctctgacaagccaagaagggtgacaagtgtctaagctcttttaggaatggagagctgggaaaaaatttagagctgtttagaaaaatgatgaggggcatatgtttgctaaagaaatttcatgacatatgccttctgatcgccaataacatgcattctctcccaattagctaagaatctaagaagagaaacagcagatgcaggacccgggatctaggaaggatctggactggagtcttggaatatctctgagtttttgtttttttttaaggattgcttttgtacgtttggcaccgtttgatgccgtgaacgcctgattggagcatctcatttgcaggactgtttaaagagacaagcaggcacaggctgcacacgtgcagacgaataatgaactcttgagaattagcacaaaagattacgtgcattctttcgtgatcctctgtaatctaccaccaaattactttcccagagttggagtgcataggctttggagacagacacatctgggttgcagccttgattctgctgttcaatgaaatgactgtgtgaacttggataattacttattctttcctggcctcagtttcctcagctctaacaaggagagctggctgcaaggcgattctagagagtcctggcaggaagcaatggtgccctcaatggccaatttaaggcgattgtgacaaagtcactgttgtgaaggttggtgcaaggtatagggagaccacaagggctggggtagtggccaggactggtacagcaggcacagtcccaccctaggcctgaaggggcagaggggcagttaccagacctgggttcagagagggctgggtggacagagccgccagacaggagctgtgacagcaaccctaccccaggaagaaaccctgacctcactcccctccctccttcccctccactgctcctacccaaggggaagcctgttgatgcagcccacgcaggggagagagggtggagacggggtctgcagggcaggcttgagagctccagcacagcgttgtctagaatcaagatgctaggacttagtagtaagtgtcaccttagtgttgtcttgatggttacagctgggttgacttatcctcattcctgatgcctagtaggtatctcataaatgttagatttgtggtcttaccacacccctctgcttactgtgtgccaagagtttccaggactctgtggtcatgctttatcagtcacgagcccctcctttttccgtatttaaatactgttcatgccttaagacccggcctacagactatccctggggtgaagtcttccctcatctgtcccggattacttggtctttcctctgcgtttctgaattatgatacatacccctctgatcactgctggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacggtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctcttctccctcaaagcacaatctgctgtatgttaaaggggcggggaagctgctgactttgcagtagcgcatacttactcacgcaattttccattctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaagctgtgaaacccagatgttttttggtaacttgtttgctagttggatttggcctgatctgaaatcatttgatgggtggggagaactcctctgaattgaaacatgtggcttttaatcgtttgtgttcatttcttttagtgtgaaagttctgcttttctgtagaggtatttttgaatgtgactatgggtcttgtcctaggcccttctgggatattggctaatgtatggtgtatgccctggacttccgttttaaagtctgaatctgagttcaaaaacatttcaggccccagggatttgaggaagggtttccagaccagtataaccagacagccgagccggccctgtaccgcgtctggttcctgggtggttcctgctgcaatgcggcccagtcagggcactgctgctgacttgtatctgcggacactccccagtgtttgagtgatgtttacgtggaagcctggcgtgtaggaagctggcgcccctgggggaactgcaaggccattttacagcattcacctgtcaccgtgtccttcagaaccagccagatgctacagagccaggctgtaccagagtccaggcccatgaaaacaaagttcagggagactctgttgactttgctaaattcatgggttccttccttccttcatttctttgttcaacaggaatttatgtatctgccataagaagacctgtgcttggcttgtgaaaagtagcagtgacacttcacatgagtgtaacatctgcggtttatggttttgttgcagtgtttcatttcgtcctcgcaaccattcagtggaccagctggtgttggcccttttcatagatgaggaaactgagggctaaatagcttctccacatctgcagattccaatcctcgtggcttttcctgttctgcggctttcataggccctctgcattatttgttaagactcagctattttctaaccccaacccacttgaagcagtggctttttcagatacccgggacaaatcacgtgaccttgtggctcagttttctatgccataaagtgggattccttcctaatccttgcaactcttaagtgaaataatctatgtgactgctttgtgaattgtgaaactcaatctggtgactatagttaataataacatattacatgtttcaaaattgctaaaggagtggatcttaaatgttctcagcacaaaaaaatgatacatatgtgatgtgatgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataataggggttttttttttgtttttttgggtttttgttttttgaaacagggtctcgctctatcacccaggctagagtgcagtggttgatcacagctcactgcagccttgactcactgggctcaagtgatccacccacgtcggcctcccaaagttctgggattacaggttcgagccactgtgccttgtgttgagtgtaacatttgactcctcaaagtcttaactactaacagcttactattgaccggaaccttaccaataatacaagcagtcgattaacacatattttgtatgttatatgtattgtatactgtattcttacaatacagtgagctagggaaaggaaaatgttactaagaaaatcaagccgagttgggtggctcatgcctgtaatcccaacactttgggtggccaaggcgggaggatcacttgaccctaggagttttagatcagcctgggcaacacgataaaaccctgtctctaccaaaaaaaaaaaaaaaaaaaaattagccaggctttgtggcacgaacctatagtcccagctacttaagaggctggggtggaggattgcttgaaactggaaggttgaggctgcagtgagccaagatcacatccctgcactccagactaggcaacaggaatgagactatgtctcaaaaagagagagagagagagaaaggaaggaaagaaagaaaataaagaaaaatcataaggaagagaaaatacatgtactattcataagtggcagtggatcatcacaaaggtcttcaacctcattgtcttcacattgaataggctgaggaggaggaagggttggtcttgctgtctcagaggtggcacaggtggcagaaaattcctgtgtaagtggatctgcgcagttgaaacccacagtgttcaagagtcacccgtacttatttctctactctcctgtctgacatctcaagagctaagcccccttggtattcattcatctttgagaactctgcattgcctagtttaataggtgaacagtacgtgtgtgttggagtttgtacagtggggagatgtattgctggtaattcagggggttagggttgctgatgcagtcagggaggcctgactgtgcatgcccagccccttcatcaccaggcgccatgtgggtgcccaaccaaagacattcatgaggctgtctctctgtgataacgaaacagctggacatacactgagaaaggaagtcagccaaatgaatattttctaacctaactctaaaaaggtagatgccaggcagcatccaggtgacgatgcttttttgaggctgacatagtggtacacagcattgaggtgctgtcagatctcttccctgccgtccacctcccagtgaccattcctcggctgcacaatgcgcctccccacatgcattgtcccacggccctccctgtacaatcggctcttcactttgcctggctcagaggtgtcttccataccaaagaggctcagagtgtcaggatttaggggaggttggaagcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaatttacttttctttagctgaacattcttacgtggttttaaaagcaagtaaacagataaagtgtttctaagtgtaataattctctttcctgatgcatagctaacaagcagtgagcaggcagaggggccctaaaccaaaggctctctcatttactctgtaaaaaatctgttccacactgcgtaacctccacatccttctcctaaggctgaataaattgggtgccaccctttgaaatgtagtactctgtttggcccaggaaccgtagttagccgtctttcttgaggaaagctgattaatcttgttttgccaagcagaaggattatgggtatggctgaaccagttttgtacgctttgaaatatcagccctgtcaattttgtgtttctcagtgagggaggaacaggggacggtctcacgcaagagaaatcctggcttttgatttaaggaaaaaacccccagccacttagctttttttctttttaatcattatcttcaagacaaaaattcaaataccctaacatgtacaattatatagtgtttttgttgtagaaaatatcatttggtagattatcaagactgacaaaaataactatctttacctattaaaaacgattgagatggccaggtgtggtggctcacgcctgtaatcccagcactgtgggaggccgaggcagaaggattgcctgagcccaggagtttgagaccagcctaggtcgcatagtgagacccggtctctataaaaatttagccagttgtggtggcgtgtgcctgtagtcccagttacttgggaggctgaggtgggaggatcgcttgagcctgggaagatagttgctgcagtgagctacaatcatgccacagctctccagcctgggaggcagagcaagactctgtcttaaaaaaaaaatttttttttaactatagagatggaggaggactggctattttgcagatcattataccaatcctaatcaatagctagttatcaacaatttcatcaactcaattggaattgagacttgagtttagacaagctgaatatttatttttatgctccagaaaacctgacccaagaatcccttttacatctgccaggaggttgctggtgcctgggtcagctgcccggagcacactgtgcctgcgtggagacctttcttagcagacgaaggccagcagcatcagagcagtgcaaattgcaagcccaagatctaaaacagatgatgaagagctatgtatttgtcactgtatccttccacggtgttttatgctattgtaacttcaagagttgacacagttctttccccaacactaaaacatgaaagggtcaggtagagctgttgccattttcatggaaacctagagttgtaaaggacctcggaagattcaggactagatttcatcttaaaagagacattgaaaaccagtaactcaaaaggaaggtcaaaggaacttattttatttttatttaaatttttttagggaccagatctcgctttgtcactcaggctggagtgcagtttcttggcatgatcctggctcactataatctcgaactcctgggctcaagcaatcctcacaagtagctagactacaaatgtgccccaccaagtccagataattttttttctaaattttgtagtgctgggatcttgctgtgttgcccagaccagtctcaaactcctggtctcaagtgctcttcctgccttggcctgccgaagtgctgaggttacagacatgagccactgtgcctggctggaaagtattttattgtaaagcattttaaaattaataggtcatgaaactataaaacaaagaatagattgcataatggattgtgtgaaaatacaagttaaagctattttacagagcagttagaggcttgtctcatacctcatctgaggctccagtgaatcccaccccaaatggaccagttagcatgcagccaataagacatcttcctgggccacagacaggtcctcttgtgcaggacagctgtcatgcacatggggctcaatggatgttattcttacagcgacctcgtgccaagcactatgctagcatatatgctcttcatttattgcagtaatccttggagggtaggttggattaccttggatttacagatagaacagctgagctcagagagggaaatggaattactcagggtcacacagctagggaggggcagagccagtattcagcctggtttgtgtgattccagaaccttcctgtggagcccatactcgtggcttgagcattgcctagtcattttgatatctgcgagcttgagtttccccttatgctaaaactgggatctgtgaggcttggcttttttttttttttttttttgagacagagtctcgctctgtcgcccaggctggagtgcagtggcgcgatctcggctcactgcaagctccacctcccgggttcacacttttctcctgcctcagccttccaagtagctgggactacaggcacctgccaccactcccggctaattttttgtatttttaatagagacggggtttcactgtgttagccaggatggtctcgatctcctgaccttgtgatctgctcgcctcggcttcccaaagtgccaagattacaggtgtgagccactgcgccctgctgaggcttggcttctaagaactgcacaccttctaatagtataatgatatgcccccttgttgtgtcatgactaacattgatttattttagagaaaattgtaattgatctatttttcttctgcaaacaatggtttctttttgactttgttaaaatgaagatgaatagctttttattttagagagccaaattgtagcagctctttgtaaatactttctgcattctagaaaaacaactttgattggatggcagaactggagattagtagaattaggaaaatttctgagttactctttgttgggtttttgtgagctaaggggatttttagggtgtttgtgatgtttctttatgacttgaaaggtaaattgcgtcggtgacatcagccttgattctgtcgtagagatgcttacgagatgagcatcttgtgtcatgctcagaggtaaagggcggctcctggaagatagaaatctgacaggggtaagaatctgacaggggtaagaatgtggagattcttgtgaagcaagcacttcagttacggcagctgctgttgttcagagcacagatgtttgcacattgttttactttctagtcactggctttcatcaatggaatccttccttttggaggattattattgatgtcaaatgttgtcagatgaaactcaaggcatggcctggggtacctctgtggtcagagagatccgactagacgtactttcactcatatttgactttattattttttttagacggagtctcactctgtcgcccaggctgcagtgcagtgacatgatcttggctcactgcaacctccacctcctgggctcaagcgattctcctggctcagcctcctgagtagctgggactacaaacgcccactaccatgtccgactaattttgtatttttagtagagatggggtttcaccatgttggtaaggctggtcttgatctcctaacctcaggtgattggcctgccttggcctcccaaagttatgggattataggcgtgagccaccgcacccagcccatgtttgatttgattcccacaaccacagtctgtctgtaggcagataggcctcgtgctacagataaggacatcaggagcttagaggctggatggatgcttcactcagctcgcctggtgacagtgggattcctggtccataggtcttcttctgacccacattgcttcttagtttggtccaactttgaaagttgcatgtttcatttgaaatgaagaaggcctaagccagaatggtacagctgtcacatccaagtgtaagatccatttctaactgccagaggcatggcagatgcctcagagaagggaggagtccatttggatggagctgtgtgtggctgacatcttcctactccatgtccttcactttggcacgtaggttagcagttctcaagctttttggtctgtcttgcgtttaaatggctgttctcccaggcttgattttgtaacaccgtgctttgattccttgagaacattgattctctgagttatgcagaccttccaaatgtgacatatttcattatacaatatcaaaaaagcacatgggttaatatcaacccccaatgtcatcaaaacagcatgtaggtgttggggagctgtcaggcttacagaggctggtacaagttttccaaagttctttcttttttttctggaaagctcaaatttatccttggcagcaaatgctgttgtttttcctggagtgacgggcttactacattcatttttttgagaaaatgattatagaacactcaggtgtgaagaaccctggtttgtccatcagttgttctttcaagtgaaaatgatgttccctcagaagaagctcacagcttgactgcacagtgctcagtttggctggtgtgcagcaaaagtgcttcataaagagacctgtactcaagggttgagctttaataaaattaatattgtttacagcgtcatcaaaggcctttgtatatgaacttggcatctttcttgtaggtggcagtgaagaagagcacagcgacgtggtgcctgtcccggctggtgctgaggcagcccaggtgccgccaccatggctcccgcagcattagtgcaggtgtcacacaacgacaaaggaaattagagcttggcattgttaaggacgtaattctgacctcagggacttcctgaaggggtctcagggactcaggggtctgtggaccacacttttagaactgctgctgttgagtattggaaagttccccattcggcacattccttgagggccgactctgtgccaggtgttgtgctaggtgctggggatactcagatgaacggcacagtccctgactgcaaggagctcacggtctaatggagaagggggtcaagtaaacagatgcttgcaaaaccttctcgtaagtgccatgatcacagtaagcagaagggatgctctgctagagtgtaggtggagcccccagcccagcttggtattctggtggtggtgataaggggtgtttcctggaggaagtatcactgagctgagtttggaagggtagaagtagaagtaaagccagttaaagaagatgggggaggtgttccatgaagatagagtggctcgggaaaaggcttggaagcaggcgaaagtgtgcagtgttcaagaaaccacaaatagttcagtagggctgcagtacaagagttgggggtgggggctcagggataagagggggccaaagaagtatctggaggccagatcccaaagacaatggagatccactacaggagtttagcagggatgtgaggtgatcaaatctgcactttggaaggatcactcagacataaagaagaggaatgggatgcggagtgatgagagtgatggataaaccagttgaggttgttgccggagtccagaaaacaccacttaggcccaaaccaaggaggtgacaatggaggtgaatgtgtggatatttagaagatatttaatgtcctatatctgcagatattcgaataggcaggatttgatgattgattcaatgtagagggcaaaaaatatggaatcagtcaaagatacaccaagatttgtagattgatggctgcacggtggtgctttcatagaggtgaggggtgtgggaagaggattagaggcaagatgaccatgcgaacttcatgtatcatattcacacacacgtgtgcatcactctatcttcaggcagaagtgtccagaaggagtcagagctggagcttgagagggttctggccttgaggtgtcagctgaggagtcatcagtgtaggtcgtggttgagggcccccttgttgatgagatcacccagaaggagagtgtggacttgccgactatagtcacagggctcaagtcaggagagaagtcaaagcaagccacgggttttaggaggagggaaacctgaggcctggatcgtcctggtccttcacgtctgcagaggagagcagagaagaattttaaattattaactcctcaactaaactacatatcgtcagaacatgcttttcaaattaatttaattgttgattttatttagttttttagagacagggtctcgctctgtcacccacgcttcagtatagtggtgcaatcatagtttactgcagccttgagaaactcctgagctcaagtgatcctcagcctcctgagtggctgggactgtaggcatgcaccaccctgcttggctaagttttttaaaaagttgttttagagacagggtcttgctatgttgcccagattggtctttgaactcttggcctcaagtcatcctttcaccttggcctcccaaggtgtggggactacaggcatgagccactgcgcctggccagaacatgcttttaaatgtaacatactaaacatgatattttatgagaatacagcctatataatatacgattttgttcctgagctcacacagactttaggtctgtaaaggatggtaaaaataccaattacagtttatatttccttttcccaccagaacatttttattttaaaagtagggtggtttttccttcccatctatggtttcatagttctcggaaatgttaacccttctttctctatacgaataaggtgtcctggtaattttgcaagtgatgatttccattatggtgggtggccacgacggaaatgatgttagaagtgccagcgtgcacgtgaagtttagacaagatctgttccttggccctgcggtgacgggaagaggggagatggaggtgttcactctcgtcttagagcttggtgtcaggaagctctgtctggaggtttccctccgtggtgggaggggtgaagcagacatgggagggggaaaaggcgggtctgcaacaggagcccagcctctcgcaccgagcatccctcagtgaagcgcccaggcccacaccacgcagccagcctcactgggctgggggagggctcacgattactttctgtttctctgcgtttgaaaatcttgtgtaatgtgcttctgcacttttaaaatcaagaggaataaaataataaccaaataaaatgactcttagccctgagcttgtgacacacaggcaatttgcttatcacctaggccaccaattaatagtacttccctataactcagggcctggggggttccaatggaagagctgagcatgtctggaggatgttcctgtctgataccagccatcctaacttccagaatataggcaacttggcagcaagagttttaaggttattatcaacctggtatgtggttgtggaagttgatatatctttacatatttttacttaaagctttttagctctacctatacatgggagcaggggctaacacagtattttgttttattgatatatttttcgttttgtggttactgaaagtgaattgtatggcacgttgctctcacttgtaatcagtgacggtgtagcctaagaaacctggtcactcaactgcattgctcagcggagaggaagcttctgtacgtcttggaccttactattggtagcccgtgctcagcagctggcctcttgcaaagggaggactattgaggatgaagagaagaatcttgacatctcaacctcttctcaccctggtttctgcatcatagttttaccatttggttagaacaccagttcaatgcacagtcagatatacagtgcaggcaaaatacgaaaccaaagatacagagtaattacttttccattatcccaatgtactttttctgtgagcaaatgaattcctaaccacagcttgtataccggtgtcttaacgtcaggtaaaggatccaggggcaggttccaaattgaagctatattttgctttagttcacctccattaacacttaggtccaagtgtcgtctctagtcggttgctgtaaactgaactgaagtgcctccactacaaggagatgaggaaaagcatggaaggaggagccatgtggtgggaaggtgcacggaggcccggtggcagatttcagctgagatttttcaaaagcctacacactttctaacagtggaaccacttgccttagaaagtgcccgcccccaattgcatttgaaggttcaagcagaggctggatgatgcctaacatggttattgcagcaggacttcttacatttactttttttttttttttttttggagacagtgtcttgctctgcccaggctagagtgcagtgacacggtcatagctcactgcagactcaagcacctgggctcaagtgatcctactgcctgagccgcccaagtggctaggaccgtaggcatgtgccaccatgcctggctaattttgttgttgttgagacagggtctcacttggttgcccaagctggtcttgaacttagtcctcctgcctcaacatctcaaagtgttgcgattacaggcttgaggcaccacgcccagcctcttactttaacttttaaatttttcctgcttttatatagagctttttaaaatttgagcctctccaagccgggcaaagtggctcatgcctataatcccagctgttgagaggctgagacgggggaatcacttgaggccaaaagttcaagaccagcccgagcaacatagcaagaccgtctctccctcccttttgtctcttaaaacaaaaatgcctcccagtagccttgcaaaacaagaccattatccatatgatacaggtgaggaaattgggtctggctgagtgacttgttcaggataatttgactccacatcttttgacatccagggctctttccatttgtcacacctgctgccttctgctccaggagaagcagattgtgccactgcactccagcctgggcagaaggaaggggacaccggcccttttgactctagagtgtctgtgccatgtgacaacacatgatgaaatggaataggaatggatctaaaaatcattgagattaggatctacagatacatttctacgtgctaatatgtcggttttataatgtacttctgtggctaaccacagaccactggcagggaatgtatctgtggttagatagctagagtgtttgttcactccctatcaggagggcagtaaatcaagaaggcaggttgaagcacagcttcaaatgctgccacgtggctgtggaagactgtggaataagcagcagccagccagcctggtgtgtgagatgagggatccgatcggttgctcgtgttggaacaaaggcattttgcagccctccaggtggttgcagatgattgcaaggggaagctctgatgtcctaccagagggcaggttgcatgtatcttcaatatagttaggagtccttagtatcctaggacatatgtttttttttagttccaccttttgagaccatagctccatcgttaatggtgtttttgaataccaaatgcaggcactatatatgagaatacatgtgcatgtggctgtgtgtgtatgtgtgtgagagagagaggggaaaccctggtaactgatgaataatcatttaacaacactcagctgtttgaataacaatagtaataattctttgtatttgtaagctccattcacagatatgatttgaatggtaatataactagggttaaaaatcattattgttctcaccagtgctctgaggaagttgagcccccagctggaggatgagggcagggaaataaagatcttgtactgcaccttctctgtcttcctttgatttatctttttcatattcatttatattatttctccacaccccctccatctctctcattttctttcttagcccctcttgtaggtgatacctcttggactgggacttgcagagccagtgattgtgccaagaaatgccgtttcttttttctttattatccccatgccccacatgaaaggccattgaacttaaacttgcctgcagggggtggcagtagaggaagcccacttggaggggctttgccagccaaagccacactcctcctttcttcagttgcgtttcttatttccatttctttggttcccgctcaggctgctgaagcgtctctccagtcttttcctattttagcacgccttctttttggcctgctttgccccaccagacatgctgttgtcaccagtccaatccatctgtgttttctggatacacactgggtgtcaatgctttgacaagtgtgggttccagcaagcctaagcgccgggccctacagagccatctcctccgggaagaagacccagccccctgtgcccttctggtttgagatgcgtgatcctgccgtgccctccggttccagggtggggtgggacggccagcttatgatgtgtaactagctgcttgtcgtccagactcagttgcttttaataaaattgccacttaagagaccctgctgctggcagagtagcttcttttcttctgcttgtgctagttcccggctcacagcagcatctgccctgcacgtgggtggtgtcggccttgccctggccgcactgtggctgtgtccccacttagccatcagaaccaggcatttccagtggagtgcagtgttgcaggagggtcaccaggcttagtgtgatgaggcctggattacacttcgggtctggacgtcctctctgagcctgaatttctgtgatctataaaattggataaagtatcaaataataccgatcctaacagtcttgatcattgtagaaacaaatgaaccaatgtctggttagagcctggaccgtgaaagtgctagaacgtgttcattcttcctgcgtagattgagtgtctccagggtgccaagcccagttctaggctctgggaaagagcagtgaagacaacaaaccaacaaaacaagtcctcacattctagtgggagagggacagtgggcaagcaagcagataagtgaacaagagagttccctggagggttgagtatggtgaagaactaaaacagtgactgaagggacagagtgtgtagcctggctgtcacttggtatctctctacttaaactggagtcaggcgccatttcctccaggaagctttccctgattcttccaggctaaagtaaccacagctgtggtgcattgtgtagctactaggccccaaggactttcccatgcatcatctctctctcttttttttaagatggagtctcgctctgtcgccaggctggaatggagtgccgtggcgcgatctcggttcactgcaacctctgcctcccggattgaagggattctcctgccttagcctccctagtagctgggattacaggcacccgccaccatgcccagctaattttttgtatttttttagtagagatggggtttcactatgttggtctggctggtctcaaactcctgacctcaggcgatccacccgcctcagcctcccaaagtgctgggattacaggcgtgagccaccacgcccggctccatgcatcacctctaatcctcattctcctctatgtgctaagcgttattctcaccatgtttcctctgtgtcttatttatttattttttagatgcatcacgtttttattagggaaatgtaaatcaaaatcacaataatacagcatggatccctgcatacacatactatgtacacacatatgtatgtcagtaattggcctcggaaatgcaaatcaaaatcacaataatacagcatggatccctgcatacacatactgtgtacacacatatatatgtcagtaattggcctcaacacagtaagtagcttttcaggtcttatcagtgaaaatttcttttttttttcttcttgtaaaaatcgctttaggggtacagtgcaggtaggtttgttacatggacatattgcataatggtgaggtttgggcttctggtgaacctatcgctggaatggtgaacactgtaccctgaacagtggaccccatagtgagcacaataggcgattttcaatcctcccccctcctaccctccacccttttggagcctccagtgtctattattccactgtgtgtccatgtgaaccactgtttagctcccacttatgagtaaggacgtgcagtatagaattttctgtttctgagttactgcacttagaatagtggattccagttccatccatgttgctaaagaagacatgatttcattcttttttatggctgtgtaatattccagggtcatttttatttttttgagacaggatcttgttctgtctcccaggctggagtgcagtggcacagtctcagctcactgcaacctctgcctccagggttcaagtgatactcccacctcagcctgacaagtaactgggactacaggtgtgtgccactatgctcggctagtttttgtattgttttgtagagatgggggtcttgctatgttgcccaggccagtcttgaactcctgggctcaaatgatcctcccaccttggcctcccaaagtgctgggattacaagtatgagccctgtgcctggccaccacattttgtttatccagtccttcattgatggacacttagattgattccatgactttgctgttgtgaatagtgctgtgatgaacatgtgggtgctgatgtctgtttgatacaatgatttcacttcctttggatagatacccggtagtgggattgtgggtggaacgtacctcagagagatcaagctactgcccgagatcacatactatcaaggggcagaactgagtgtcctaactcgagactcagccctttctaccacatctccttgtcttctctgtcccaggccttatgttcacctctcttcaacctcaccacagtctggaaatttatgtttctgtgtttttcctgtcagcctctgaactcctgaagggctaggaactgttattgtcagcacctggagccacactaagcgcttactaggagtttattgcaagtttactgagttcataactagccccagccccttgccatgtatttccacttagatgccacagatttctccttcagagtgcttgtagactgcaaagggagcagtcgaggtgaatatgcttggagaggacataagggaaggttttttcatgtaaacgaactcattttagatgtaaggcatcacttttcagtgaagcagggactttttacaaagtcttgcctctgaactttacagtaagcaagccgagatccatgcttaccactgcaagaaaactttggtgggccgttgtacaacagtaggcaattgtgttggcttaatgtgagttcttgtgaggttgacctttgtatgttttgaaagtctttagcatttaaagtctgcttctgtgcattgatttttttttttttttttttttttttgagatggagtcttgctccgtcacccaggctggagtgcagtggcgtgatctcggctcactgcaacctcctcctcccaggttcaagcaattctcctgcctcagcctctcgagtaactgggattacaggcatgtgccaccacgccctgctaatttttgtatttttagtagacacagggttttgccatgttggccaggctggtttcgaacacctgacctcatgtgatccgcctccctcagcctcccacagtgctgggattacaggcgtgagccactgtgcccagccctatgcattgattttgagcaagaaagggataggactaaattatgtggatgcactgtacaattcccaagaagggttagaattctagtcttgccaactcactcctccaagggcccaagtttgatcaccggaggattattccttaagcagcacgccacagccttctgcagttccccatgggcctggtgagaatgagcccctgccccattgtgaatggacacttctttgttcattgactaacgccactgctgtgtaacaccgtggtagggtccaattttagtatcatcttgcttcttgggaaaaaaaaacaaaaaaaaacaaaaaaacaccttaggtcagaaaaagacgagactattgaagaattccatgcatgttataaatgtgattaagtccacactgctgccaaggagtggaaacaaatcaggcacagaactcatggtaggacttcatcaggactggaatattctacacaacaaaggacttcatcttgactagggacagagcaggatggagctcagcacatggagaagactatttgaggcagagagtgtcagtaaactcatccattaatttttttcattcattcagcgccagattttgtacacgtactaagtgctgaataaatacagcagtgctgcaggcagtcccagggagccagtcactgactgtaaatacgctggggggtatttacatgtagagggggatgaccacctgaagacatggggagaagacagccagtgagagaggcctcagaagaaactaaccctgggccctaatccagtctggctagtgtccttataagaagaggagattagtcacagacacgtagaggaggatgaccacctgaagacacagggagaagatggccagcgagagaggcctcagaagaaactagcgtaactggaccttgccggttttgagtatcgtgagtaccctggcagcatagctggtatgagtactcgaagtaccccggcagagtagcggcacctagtagccacaagtaaggtgcaaatacccttgcagcgtatccaggcccagtaggcacgagtactataaataccctctgttatgggcttacttgtgttaccccaaattcatgtgttgaatctctaaccctagtgcctcagagcatgactatacttggaaatagagtctttaaagaggtgattaagttaaacgtggccgttagagtgggccctactccagtctgactggtgtccttataagaagaggagataagacttagacacatagagggggcaaccacctgaaagggagaagacggccagcgagagaggcctcagaagaaacgaaccctgctgaccttgatctcaggaagctaaacttgatctcagatgtccagcctccaggattgtttaagccccccagtctgtagtactttgttatggcagccctagcaagctaacatgccgctgtagagtgtgcagacccgcaggcatgggtcccgtgagcacccagcagggtgtctgggtgcagtagatgcgatggttggtgtataatatgaacactgtctctgcaggattcttgcctgtgaatgaaatggagggaattgaagatttcggtgtgcttgcagtctaggtcttgatctcaggtcatttcatagatgtttgagagttagagttctttcttgttatgattctagtcatgtatgtgttacccaacaatatttcattttatattaaaattacagatgcttgttagctcttttgttttgaatatttctgttcgctattcttatacagcagtcttccgttattcagttttgctttctgcagtttcagttacccacagtcagctgcagtctgaggatattaaatggaaaatttcagaaataagcaatttctaagttttaaattgtatgccattctgagtggcaggatgaaaccttgtgccgtctgctttcatccctttgtcccatgcacccacactgtagacgcccctacccatgagtcacttaataggagtctccgttatcaaatgactatcatggtatcacagttcttgtattcaaggaacccttattttaccagtagtggcctcaaagctcaagagtagtgatgctggcatattgttataattgttctattttattattagttatttattattacttaatctcttacagtgtctaatttatgaattaaacatcatcataggtcaccataggtatatatatacacttgacccttgaacaatataggggttacgggtgctaatccccacacagttgaaaatctacttttgattccccagaagttaactacaaatagcctgctgttgaccagaagccttaccagtaacataaacagttgataaacacatattttgtatgttatatgtattatatgctgtattcttcaaataagctggagaaaagaaaatgttattaaggaaatcataaggaagagaaaatgtatttactattctgttagtggaagcgggtcatcataacggtcttcatcctcgtcgtcttcacgttgagtaggctgaggaggaggaggaagaggaaagcattggtcttgctgtctcaggagtgacaagcagaaaaaaatccacatagaagtggatccacgcaattcaaaccagtgttgttcaactgtctaggaaaaaacacagtgtatatagggttcagtgctgtccacagttccaggaatcccctgcgggtcttggaatgtatctcctgtggttaatgggggggccactgtacagactgggcccttctttgggcgcccctttttctctgtttgaccaactcctttttattctttaaaacccagccaccagtgtcacctggaccaagaatcctttcctgtgtcatccagggcccctctcagtgcctctggaggaggctctgcctttttctttgctgttgcactctcatgagtgacagcatctgtccctcaccccacaaagtctctggcccagaaggttctcttcattattgctttttgagtgaacacttgaatgaatatatcactttcttgaaagccagtctttcaaaatggttgaattattttgttatttttaaattgtggtaaaatatatgtaacaaaatttgtgattttaaccattttaaatgtataaattcagtgacattaattacattcacaatattgtgcaaccatcaccactctctacttcaaaaattttcatgaccccaaactgaaactcagtactcaatgaagcagcacctccccatccctcccgcctcccagcccgtggtaacccacagtctgctttctgtctctgaatttgcctactctgtgtatctcaccttactctgtagtagtgacttagatgaaatataatatttgtctcatacaatactagtctttttgtgactggtttatttcacttagcataatgttttcaagttccatctgcttaccagaactatattcctttatggccaaataatattcgattatatggataggtcccattttgcttatccgttcatccatccatggacatttgggttgtttctaccttctggctattgtgaataatgctgttttgaacatagctttgaaatacctgttcaagcctctgttttcagttctattgcgtgtctacctaggagtagaattgccggatcatatggtgatcctacgtttaactttttgaggatctgccaaaactgttttccacaatggctgtaccattttacattcctaccagcagtgcaagagggttctaatttcttcgcattcttgccaatgcttgttattttcattttttttatgatagccattctagtatgtgtgaaggagtagctcattatggctttaatttgcgtttctgtaatgactagtgatgttgagtgtcttttcatgtgcttattggccatttgtatatcttcttagagaaacatctatttaaggtctttgcccattttgaaattgggttgtttatctttttgttattgaacaaaatggttgaaatttaaaagaaaaaagggtgctacttgaaaggtggacccttcctaatacctggctttccaggaagcttattctctgatggtgctagattgacaatgttattttaatcatcgtttcctcttccctcctgctttcttggctttttttgcactttttggagcattcatgttttgcctttttgttttttttgttttttgagacagagtctagctcttgtcacccaggctggagtgcagtggtgcaatctcggctcactgcaacctccacctcccgggttcaagcaattctcctgcctcagcctcccaagtagctgggattacaggcacccaccaccgcccccagctaagttttgtatttttagtagagacggggtttcaccacgttggccaggctggtctcgaactcctgacctcaggtgatccgcccgcctcagcctcctaaagtgctgggattacaggtatgagccactgcgcccattttggattaaacttcaaatagtactcaaagaatcagactgccgataatgtaggacaactgtccagaccgggccctttgtcagatgtcccttttctctctttgaccaactccttttgattctttaaaactcagccaccagtgtcacctggatcaagaatactgtcctgtgtcatctaagggccctctcagtgcctctctaaattccaaattttcactctggaaaattcaacaactcaaatgtattttcaagtgtattttaaaaattagagaactagattgtcaattcacgttatgtgaatgctctttaaaaagtggtaatgttttataaacgtactctgagcagtgttttccagtatattttggtgtgggatttggagcagggctttgaagtggaaaggcaaatgttttcttgggtagatctgaatattccgcaaaatgattccattgatcatccggtcgtagtctcactctctgaactataatgaaaagagagccaggggagagtgcagctgctccagggacccgggacaggtaccctggaaaggcatgggtagaggttccccccatcgttgggcccactggcatcactcctgttgctcccatcggcagctgtgggccagggcctctcatcctgtgtggaatctggcatcaggaattttcagtgggattttgaaagctattctaagagagtaaaatggtgggaggcatacacttctgtgctggctgctgaaatatgtggtatactggcctggaatacaactattttctctttttttaaatgaacgagttcattaagaaaaaaaatctgctgcaacctatagatccaaacacagttcaatacatcttttttttctttgtccaaactgaatattttcttatttttaatatcctgcctcattccatgaaggatttatgatatcttccagcagttgagtaggtttgctgaaatcattaacaaatatacaatttttttcttttcattttttactgaatgatgggattttttttttttttgctgcttcctccccttaacaaaaaagctttcttgaggtatcaacctataataatctgagcatatttaaatgaacaatttgataagttttgacatctgtatatgttcatgagaccataaccacaatcaagataatgaagatgttcattgcccctaaagtttcttttgtgcccctttgtcagccctccctgcccccctccactccaactactgacctgtcactattgattagtttgcattttgtgtaatcttatgtaactggaaccatgcagaatgtactctattttctggctgctttcacccagcacaattttgatattcatccgtgctgttgcttgtatcaatgttaatatgtttttatcgctgggcgccattgtatggacctaccacagtttatttatccatttacttgttgatggacatttgggctgtttcccaaatgtcccagtagtttttggctattacaaataaagctgcttttaacatttgtgtccatgtctttgtatggatggaggctttcatttctcttggggaaatacttgggcatggaatggccggactcaatagtgggtgtgtgtttagctgtctgccaaagtggttgtaccacctgacatccccacagccatgtcagagatgcaattgctgattcacatgctcaccaaaacttggtgtggtcggtctttttattttcagaccttctaacgggcgtgaggtgataactcatttcggttttaatttgcatttccctaatgactaatgatgttgagcaccttttgatatgcttatttgccatctgtatatcttccttggccaagtctctgttagatcttttgcttcgttttaaaattgggttattcactttcttgttgagctttgagaatgcttcatatattctggatacaagttctttatcagatatgtgatttgtaaatattttctcttgttctgtggcttatcttttcactctcctaacagtgtcttttgaaaagcagaagttcttaaatctaatttaccatttttttcttttttaaaaaataatttcaacttttattttagattcaaggggtacatgtgtcggttcttacatgggtgtatttcatgatgctgaggtttggggtatgattgattctgacacccaggtagtgagcatagtactcaataagttttgttttgtttttatggattggggttttgctgtcatatctacaagatctttgcctaaccaaggttataaagatttcctcctcagttttcttctacaagttttatagttttatttcttacttttaggtttatgatccattttgaattaatttttgcatatggtgcaatgtatggattgaggttcttttgtgtgtgtgggtatggatatgcaattgttccagcctaatttgttgaaaagactgtcttttctctactgaattgcctttgtacttttgttaaaaatcagttgcccataaaggtatcggtctgtttcttaactctctattctattctgttgatctgtttacaccattaccatgttgtcttgatgactgtcacttaagttgggcagtgtaagtctttcagctttgctctttttcaaagttgtggctagtctaggttcttcacatttccatgtgcattttgggatctgctattgagtttctacaaaaatcctgctgggatttttattgattgcattgaatctatacattaaatttttctgtagggaaaattgttagcttaacagtaatgaacagcaatgagtcttccaacccacagacacggtatatctctctgtttatttaggtcttctttgctttctctcagcagtgttttctgagagtaaaagcagtgttactttttggtgtgcagatgttgaacatcttttgccatatttatccctaagcatttcatatttttgataatgtaaatagtcccaattgtttggtgcaagtatatagaaatacaattgatttttatgtcttgatcttctatcctgaaaccttgataaacttacttattagttccagtaacttctttgtgtattccttcgattttctagttggacagccatgtcatttgtgaacaaaggcagttttacttattcctttctaatctagagagcttatatttctttttatttttcactgactaaaacctccaagataatattgaaatgtgtgatatttgttgtaggtgttctatagacacccttcatcagattgaggaagtccttttctcttcctagttcactgagtgtttatcagaaatggatgttggattttgtcaaatgctttttctgcatttattgacctgattacctcatttttcttttttagtctgtaaatacggattacattgatatttgaatgttaaaccattcctagaataaacctattaataggtcatgatgtattcttttttatataagactttcatttcctaaaattttaagaatgtttcctttttttttttgagacaaagtcttgctctatcacccaggctggagtgcagtggtgcagtctcggctcactgcaagctccgcctcccagttcaagcaattcttctgtctcagcctcctgagtagctgggactacaggtgcacgccaccatgcccaggtgatttctgtattttaagtagagatgggatttcaccatattggttaggctggtctcaaacacctgacctcaggttatgcacccgtggcctcccaaagtgctgggattacaagtgtgaggtactgtgcccggcctgcatttattttcatgagggatattggtctgtagttttcttttgtaatgtgtttgtctgattttgatattagagtaatgctggcctaatagatgagttgagaaatatttcttccttatcagttatctgaaatagtttgtgtgaattaacattattttttcctgaaatatttggtagaattcaccagtgaggttatcagtgatttgtggaaagattttgtttttgtttttgttttgttttgagaaagggtgtgactctgtcgcctaggctggagtgcagtggagtgatcttggctcactgcaacctctatctcccggcttcaagcaatcctcccacctcagcctccctagtagctgggactagaggtgtgcaccaccatacccagctaatttttgtattttttttgtagagatggggttttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttgttacttttttttctttcaagaatgtgtatattttatctaagttactgaatttattggcataaagtttttaaaaatatttctttatccttttgatatctatcgatctgtagtaatgtcaattctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcgtttttttctgcatactttgggttcctgaaggtttggttttcttaagtggatgctgagatcattccttccccatcccctacttccttctcctttcttcgtttctaatgtcgatgttgggtgacataaatttctttctaagcgacagctcacaaattttgatatgctgtgtttttatgttcattcagttagaaatactttctaattttcctttctgtctaatttgagttagtatttgtgaaagttttgtgtctagatgcattattttgcatgtggacattcaatatttccaacaccatttgctgaaaatactcttctttctctgtttaattgcctttgctcctttgtcaaagactagttgactgtatttgtgtgggtctatttctggactctctgttccattgatctatgtgtctgttctttcaccaattacatgacgtcttaattactatagctttataagtcttaaagtcaggtagtgtcagttctccagctttttactcttcttcagttttgtgttggctattctgggtcttttgcctttgcatataaactttaaattcactttgttgatatttacaaaatagcttgctggaattatgattgggaatgcattgaatctgtagatcaaattgagaagaattggcatcataacagtaatgagttttctaatccgtgaacatggaatatatctccgtttctttagaacttctttaatttcttttattatgttttagttttctgcatttaaatcctgtaaatattttggtagatgtatatgcacctatttcatttctggtactattataaatgccattgtgttttaaatttcaaattccaattgttcattgctggttcgtaggaaagtagttgacttttttgtgttaaccttgtatcatgtaacagtgttacgagagggtttttttggtcaattctttgggattttctacatagacatttatatcatctgcaaatagacagttttgtttcttccttcccagtctgtataccttttacttccttttcttgactttttgcactagctaggacttgcagtatgatgttgaatgtatatagtatagtcataataactatttaattgttcttgtctactaatcctattgtctgtgttatttctgggttagttttgcttggttgattcttttatttattttgggtcatatttttgtgcatctttgaatgtccagttgttttttcgtggaggtcagacgttgtgaattttgcctcgttgggtgctggatatttttgaattcctataaatatttcgagctttgtactgggggtagttacttggagacattttgatccttttgggtcttgctcttaagtttgttagggggaccagagtaggatttagtcttgggcaacatcctctgagtcctctccttccatgaggctgtggattatgaggttttccactctgcctgatggtgtcagggtatcaagaactattcccagctctaggtgagctctggtaattgttctaatttttttttttttttggatgatttttttttcagtcttgggtaatttcctcacatgtaaatgctgataagtactcaccagaagacttgagggcagggtgtgggagggtaatctttccagatctctgaagttttttctcttggcaatgctctcttccccattaccctctctgcgaaccccaatcgtcttggctgccctggacttacagccgtgtgtctcagcaacttagggagactcaggctttacctgggttccctccctgtctcacatcctggaaactctccagactatctgctgggctagtcctagggttcacctcttttgtttaccatctttcattgatcactcttcctcattgtctggtgtccaggtgtttgaaagctgatgtttaatatattttgtctgttcttttagctgtttaaggtaggaaggtaatctaatcactgttactccatcttggctggaagcagaagttgatggcactttttaaaaagtagctacagaatgtcaaaaaggattaaaaatttttttacagtaacaacgaatgtggatgggaggttagaactcaaactttcctttagattctaaccttaaaccgttgtagctccaccttttgataggaacctaaaagacaagttctaccataaaaacctaggtattttagtatcttccatagccgaacatatctattgttttgtcctgaaacagtaccaccagcctgttttagaaagttttttcttggaaaactaggtttctggctttggccccattggtgattttaaaccatttgaactgtgcttttctttttgttttgttgttttattgtttttgagagaggcttactctgtcccccaggctggagagcagtggtgcaatcacagctcactgcagcctcaaccttcccagctcaagcaatcctcctgcctcagcctaccaagtagctgggactacaggcatgaaccatcatgcctggctaattttttaaatcttttgtagagacggggtctcactatgttgccctggctggtcttgaactcctgggctcaaccactccccccacctcaaccttccaaagtgctgggattacaggcataagccaccatgcccggctacactgtgcttttctaaatttttatctcaattattaaaggacaggctcttatgcaggggaatattgtctgaaactaatcaaattattaagtcaggaagacaactaaatttttggatgatgtaaccatatagtactttaaatagaaaaaaattgtactaatagaagttagtagaaaaaatttagataataatagcttttattttattctttttgctgaaagactttgaaaccatggtgtaaaataaaaaatcattaaagctacctttttagatactttttgttaagtcagtttataaagtgaggatgtctatctggaatgtgtgacagatgtaacaagtgaaagttgcaatagtctccatgtaaaataaaatttggactgacagttttagatctttttcaagttttactctaatgctcattattttgtcttctcttcccttctccatctgcataattttaatctttcctttcatggttaagatttggcaacctcgtgtgccttgccaggatcattgttaaaaagctgtagtttttttttttctttctcccgtccaagctgtcccagagcctggtgagccacccttgcccttggtgtggtgtagctactgcgcctcatagcaaaaggccaggttttaaagcatagtgcttcacacgttatcaggaatttattttctgctcagctgcaggatctcttgtttgctttaaaactgtaaagtggagtgggggaaagctatcaacaatcttcaagtgcccaggtcttttagtttctgacagaaacaagagcatttctgcaaaggttggggagtgcgcgcgcgcgcgtgtgtgtgtgtgcgcgcgcgcgtgcatgtttgtagtatttagtaaacattccaaagatttcaaagtctccagggctccacaggatgtctttgttgacttcataactgtggttaggcaaaatgaaatgagagtccaggataggtcaagataaggtaattagcaaattcccttaaatactcaactagagaatttcaatggccagtctttttacagatgattgttcttatttttcctcttttgttttcaattacaattcattaattgaaacgtagtaacgggcctgaagttgtgttctgtactcacctgtgttttgatctttatctgtctagtcctcatattactttctggcaagcttgtgattctggcatataacagttggggcagggtgggggctattgatttgatccctcatctgtgttcctacatttctgttatggttatttgttggccagtctcttcttgctagactgagtgcccttggattgggaagatcgcattgcccggcactaggtctgccccagaaggatgctcaatatcattgtacagaattaaactgaaagtttgtttcctttaaactccatgtcatccaaggtaaacacagtcacatgttgcctcttagggtgatcttgagtattttttctcatctccatcaccaccattatccaacctaaggcttgtaaaagatctttataccatttctttccagattcaagaggctctgctgaagttcttttaatcaatattcgatgacaaatttttatatcaggcaaaggttgttgtagagctctttaagattcaattatgtgaacattagttcttgagcttcatttgaaacaggtttattttgaggtgggatcgattcttgtcattttctatgaagtgatgaacgtcagagccggagctcttgtggcaggtccagcttggaggtgagcaggacacagggttcctaactgacccagatgatccaaggagaactgggagtctgagaacagaaataaagctggagcccagccaggagtggtacgcagggctgcgaatctgacagcaaggccgaaatccaggcccgcaagtggcagagcaatgacagttaattgcttctctgtactgattgcttgtatgtttcttttgctattggatactaataggatgactccgaatatgacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacagctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggacactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattactaggccactttaacctccgggaatagcactcagataacaatgtcttagtattactggaagatttacagagtcaagagcctgctcttatccctggatactgagataatcacatgaatggagaaaaaagcatgcttctctcaccttttaatagagtgaaacacatcatgttaccggaaacccttttgttctgttttttacagtaagagaaaaagtaattaaacttcaaagtcagatctgtaaatagctacatgaggacctatggtaaaagcagagctacaaggtcttctttttgcttctgaaactgcgggtgatgtaggggctgcccagacccatggcatcccttgaaactcagaaagaagccagtgcttggctgggttctcatgagagtcaagttggagctggaggctatgagaggtaacacttggcctgtccttttgccactggtcgtgtgctgccaagtgggagggctcgtgtggcatcaaaccatgccttatcttaaggctaacatcacatttcctcaacttggccagaggtgctgcagagagagacctgcacagtatttgcagaatttgttcaataattattgttaatcgttgatttcactgaagatcaatgtttgctttttgctcttataaacaaaacaggaatattcataacaatggattctagtaaggctcaagtaccatttgtgttgagtgtctgtatgccgtcatagtattagaagtttcatacacgctaacattcatcttcacaggaacgtcagaaggcaggtggtattaggtcacatagctaataggggacagattaggaattggctactgctcagtttgaatcccaaatcagtgctctctctcttgtgcctctaaagccccaggacccagacagggcagtataggtaacccttagcagactactctcaacagtgtttggcccttgacaaaatgccacaaagttggaacgtgtagccctgagaagggttgttggcagaggctgcagagtggctttcagagtggttggccagctaagacatctgcatcaatgcctcgcaccactgggtgttcagttttccctctgattaaatcttgtctaccctgtgcccatagagtcagcatgtgctgcgagatcacaacgtgggagatcgttccccaatactgagatagagacaccgccccatagacgcagttacacactgccatgtgtaaacagatcaggaaaggagcaggtgcccagcccaaccggagctccagttcacacaaaagttttagaaaacccaagaggtaaaagtttagagaatattgtcttcttcaaacctccctctaacactgtaaagtgataatagacaagaatgtaaaaacttgggggaaaaaaagctaaagctcaattattgacactgttttaatgacctccacagatagatttgagaggtataggagcaaaaatgactttaaaataaataagttgttaaagttttattggtgctgcattcccaacctgaggttttctttgatgaaattcagatgaagtttcacatcttgtgctgtggaatcctatgaaatgcttagagattcaaatggtttgtgttggttaaagcaagctttaggctttgttcttcattatgctaatcagtttttcccccagcttaattgaagtgtaaagtcatttgaacaacactggtcttttctgtacacaagaaggttaagaacctcagacagctcatgctgctgccaagaagtctcccagtcgtattcttcagattaattacctgcagaaacagaagtaagaaaatccattacaggttaaagcaatgattttggcaggatctgaaaagcactaggattatgtcatggggaaaacttcagcaaatctcacaaatgggggctctcctaagcagatctgacatttcagtttttaaccatttgtatttgaaggcaaatattgaggtggtgggggtttttattaaaatattaaaatcaaactttttcctatataaattcagcaatataatttaaatattctgatttgtgcagttttattaaagccactgagaccacagtgatgctaaagtttttgaatgcagggagcaggccagtcttgccttactctgtatgttgttttataatattgatttgaaaatgcaaggttatactacagagaccaactttttcctcctcaatcctgtgctggcagccacaataaatgtgcttgagtcccagcagtgagcgtgtgtgccttctctagaagctgctgtctgcacgaacaacccaaaaatgtcatagaaatgcacagttctaggctgggtgtggtggctcatgcctgtgtaatcccagcactttgagacgctgaggcaggataatcgcttgaggctaggagttcaagaccagcctgtgcaacataatgagaccccatctctataaaaagtttaaaaattacctagatgtggtggtgtgcatctgtacttccaactactcgggaggctgagataggaggattgtttgagcccaggtcaaggctccagtgagctgtaatcgcaccactgcactccagcctgggcaacagagtgagacactattgctaaagaaaaaaaataaatgcatgagtctatgctacagattctttcatgatttaaaaagcaaatattattaattatgcactaatttctaattattcagtgctaatttgcataaccgttgagacagcacataggaattttgttaaacttggatttgttttggtaatttttattggaaacaacaatagtaacaataacttaattacagcttatatttatttatacatgcactatatgcaaaaagtattctaagtactctaaatgtgtcaactcatttaatattataacaaccctatgaaatactcttgttgcacctgttttatacatagaggcagatagagattaagtagtttgtcctaggtcatgtagctagtaagtggcagagctgggatttgaacccaggtagcttgactccatagtccgtgctcttaaagactgaagtctatgcctcttctgccagtgctgtcaacactgacttagctctagaatgtcttctcctaccttagtagaactctccctgccttccgcctgaggccagagaccttcccaggtaggtgtgtgttgacccagcgtcctacacaatggttgttacaccaacctgactctgccttcttttattcacacattagaagatttcactgaactgtttaattactcctcagagggaagacagatataaaataccttcttatcttccccacttctctctcccagtggcatgacattttgaagtgagattttctttccctcctatccaaagtcaaaggagaaatggagaaattccacagaactactgtccattcacaagaagttacatagcacttaaggacagtctctttcccttgagcaataagtacttagttttcattgaaatatttctctgctgagctctcatagtataatagcaaccaatcccaacaagcaaaaataacttgtaaatttgcaaaaccaggccaggcgcagtggctcacacctgtaatcccagcactttgggaggccgaggcgggcggatcacaaggtcaggggttcaagaccaacctggcccacatagcgaaaccccgtctctactgaaaatacaaaaattagccgagcatggtggtgtgtgcctgtagtcccagctactggggaggctgaggcaagagaatcacctgaatctgggaggtggaggttgcagtgagctgagatcataccaccgcactccagcttgggcaacagagtgagactttgtcaaaaaaaaaaaaaaaaaattggcaaaaccaatgagtggaccttatcttacttaaatgctcataaaattactttattttatatgttaacattcaataaaaactgtcatttttgagataattctatgtgttttaacaaagtatggtttaatgtaacaaccaccactaaggatatagaacattccaattaccttcaaaattcccttgtgcagtgtccccaacccagcatttggcaaccactgatccattctccttcattacagttttgtctttggagaatgtcatataaatggaatagtacaggatgtaaccttttgagatgggctttcttcattcagtataatgcctttgagacccatgcaagttgttttgtgtatcagtcattcatcccattttattactgagtatattccattgtatgagtgcaccacagtttatccattcaccagttgaagggcctttgagttgtttccagtttctatcaagtctgaacagagccaccagaaacattggcgtatcggtttttgtatgaatattgttcatttttctagagcaaatacttaagaattgctaggtcatattggaaatatgtgtttataagaaaatggtaaactgttttccagggtggtcgtgtcattttgtgtgcccaccagcagtgggggagagtgtgtttcatttgctccatattctcactgcacttgcttttgtcagcatttttacttttaaccatcctaatagatgtgtaataatatctcattgtagttttaatttgcatttccataatgactaatgatgttgaacatcttttcctgtgcctgcttgttacctgaataacctctttggtggtctatttaagtcttttgcccatttttccccttgcctatttttaaaattggattgttttctcactgttgagtttgtaaagttctttatatttctcattcaatagagagaaacagaaaaaagaggacgtgcacacatccccatcagtactcctaataaacagtatggattctacattgggagcataaagaatggtatatttagttctaggagaggaggagcatgagaaaaggatatttgcaagttgttcttgctttatagttttacttctttaaagagatatgcttaagacatagttttaaaaagacttacacaatattttttttgtaagagcttagcggctctcttggttaatagatatgttattctctctcagaagtgccatagacacacttgaaaattatttctatgtgtgaaacaattatctgttacttagaaaattgacagagcctggctgggcgctgaggctcacgcctgtaatcccagcactttgggaagccgaggtggttggatcacctgaggtcaggagttcaagaccagcctggccaatgtggtgaaaccccatcctactaaaaatacaaaaattagccggcgttggtggcaggtgcctgtaatcccagctactcaggaggctgaggcaggagaattgcttgaacccaggaggcggcggttgcagtgagctgagatcacgccactgcactccagcctgggcaatagagcaagactctgtctcaaaaaaaaaaaaaaaagaaaagaaaaagaaaaaagaaaattgacagagcctgaatttaagggcaagacagaattatttatccaggaagcagaagttacaaggtggcagatttcaatgtcagaggccacttattattatctaaatattccatatgttttcatgtttctgcgtttttgtttaaattgcttgtttcctttgcttggaatgccattcttatttttccagctggtgatttttttttttttttttttgagacagagtcttgctctgtcacccaggctggagtgcagtggcgcaatctcggcttactgcaaccttcacctcccaggttcaagcgattctcctgcctcagcctcccgagtagctgggactacaggtgtgtaccaccatgcccagctaatttttgtatttttagtagagatggggttttgccatgttggccagactggtctcaaactcctgacctcaggtgatccacccaccttggcatcccaaagtgctgagattacaggcatgagccaccacccccagccctggtgaatatttttattcttcaaggccaacccctgcttgatcccatttttccaaatacagctaatattttctttgttcacttatcactttatatgtttatataacttatcaaattattttagaaatttgtaggcaggtgtcttctccactaggcagagagcttcttaaggatagctgtgtgagtgaatcatcttttatccctaacaactaatttaatgcatgcttcaaaagagatactcatttacccatttattcattaatttaccaaatatttattgagttctcactgtatgttaggttgaggggcagagtagtgaaccaacagaaaagattcctgctttatggagcttacattttgttgaccttttcagataaccagattctccttttctaaaacagtggttttaaagctattagttttcctcaaagccctgctttagctgcatcccatgtattttgctatgttgtattttcattatcatttgattattctaatttctcctgatatcttctttgatccaatgattatttagaaatgtattgcttcatttccaaatatttgtagttgatttctaacaatatcattgtggtcagagaacatactcttcccatctttaaatttatttcaatctgtttaatgacccagaatatgatgtgtcctgaaaatgtaccgtatgcactgctattgttagctaccgttttctctacgtatcagttaagtcaacacggtttatagtgttgttcaaatattctatgtctgtactggttttttgtttgtttgttttaagatagaatttcattctgttttcgaggctggagtgcagtggcgtgatcatagttcactgtagacctgatctcctgggctccatgattctcccacctaagcctcccaagtagctaggactacaggcatatgccaccatgcctggctaatttttaaattttttatagagatgagatcttgctataccacccaagcttttatttatttttttattagttgttctatcagttgctgagagagggacattaaaatcttcaggaaaaattatagaattgtctgtttctaactttaattctgtcagttttgcttcatgtattttaaagctctattaggcacatatgattgcagtgtttttctgataattgacccttttttcattatgaaatggccctttttatttctggtaatacattttgacatctattttatctgatattaatattgccatccagcctttttatacttattatttccatggtatatattttttccattcatatactttcaatctatctgtgtctttgtatttaaagtgtatctcttgtagacagcatatagttgggttttgcttttttaaaaaaaaaattattctgccatcctctgccttttaattggtgtgtttaatgaaattattgctttaatgtaacatgtaatagaattattgctatattgggtttgagtttagcattttattttttgttttttacttgtcttttttgtacctctgttactcttttctttccttcttttgaattatttgaatatagaatttcattttaaattttctgttggctttttagctacactcctttgcattattctttagtcatttatgagggatcacaatatacatctgtgacttttccactacagttaatactaaccccttacagttaataataactgcttacatgagatctattgtacaacattgtgactaacatatgtataattaataacatgtatgtatccttgagaaccactaagagagtagattttaagtgttcttaccacaaaaataagtatgtgaggtaatgcatgtgtgtgttagctcaatttagccattccacaatgtatatatatatattttaaaacatgttgtatacaatatatacaatttttgccaattaaaataaatgaaagccacttataattaatgacatatacttcatataaaatactgaaatcttgcaacttgtagatccatatttaccccatcttttatgttatggtacttgtatttattacataaaaatacattataaatcctgtaagacaatattttaatttctgtctttaaaagtttgaaggttcaaggctgggcacagtggctaacacctgtaatcccagcactttgggagggtgaagcaggatcacttgaggccatggattcaagaccagcctgggcaacacagtgagaccctgcctctataaaaaatttaaaaattagccaagcgtggtggggtgcgcctgtagtcccagatcctcagaaggctgaggtgggaggatcacttgagcctagggagtgaaggctgcagtgagctgtgatcacaccactgtactgcagcctgggcaacggagtaagaccctgtcaaaaaaaaaaaaaataataaaacttaaggtttcataataacataaaaggaaaaaggaaaaaaatgagtctttgaactgatgcaggtatttatcatttccagtgctcttcatttttttctgagggtctgagtttgatcttatataatttttctttagcctgaagaactttcattagcatttcttgcagtgcaggtcttttgatgattaattctttctggttttgttactctgaaaatgtctttattttgcttgctttcttggaagatattttgctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtatatatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccagagtgatgggattacagacatgagccacggcacctggcctgtaattgtgtatttgtgttcattaaatttgtgctatttcagccatttatttgtttgttttgtttttgcgccactgcgctccagcctgggcgaccctgtcacccggggtcttgctctgtcacccaggctggagtgcagtggtgcaatctcagctcactgcagccttgacctctcgggccccaagaaactgccccacctcagcctcctgagtagctggtactacaggcacataccaccacacctggctaatttttttttttttttggtattttgtagaggcagagttttgtcatgttgcctaggctgatatcaaactcctgcgctcaagcagtctgcctacctcagcctcccaaagtgttctctgtgttctctggttggagcacagtaagtgaagggaagaatgatgtacaatgagattggagaggcgaagaagatcacggagaggtttatagaccctgataaggagttggaaattatgattctgagtaagaaaatatgattaccataattgtaagggtagcttgccaaactcatattgctttatccttcagagtcttgaccgatggatagggtggccttgtgattgtatgacctacctgtcagttaacataattggaacagaagctagaagaccatgcagactgggtttctgcagtgtgtgggaagttgaagtggacgtattctaacatcccttccactgctaaggttctccggtatcgctgaaaacaagttggcctccatgtagaaaagtataatgtcaattaaaaccacagtttataatgaagagtgcaaatgtagagaatgaaaagaccattgtagaatgaagagttgtagttacacacagctaaagatttcatgtgatttctgcttaagagcagtatctgtagtccgtaagtgttactatgttaaaacaatgggcttaaaacagcatgctagatagagtatgtttatagatctgatttccggggaacacttaaagctcacttgatcctttctttggtttagatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaaggtgggcgtttgagtgacacaggaacttcagtagaattggtctcgtggcagaatcttgctctagcaaacacattgtgctctttaatattgacagagaatcgaaacttagaataacaataaaacagtcttagcactgtcaacataatcacacgacgtatgatagtattttggggcttgatgttggtgaattgtacagcccagtgatgtacatttgtaggtgatcattaaatgcttgttgagtcaaggaaggaacaatccaaatggaccactgagaacagttcttttttttttgagacagagtctcgctctgtcgcccaggctagagtgcagtggcgcgatctgggctcactgccagctctgcctcctgggttcacgccattctcctgcctcagccccacgagtagctgggactacaggcgcccgccaccacgcccggcttattttttgtatttttagtggagacagagtttcaccgtgttagccaggatggtctcgatctcctgacctcgtgatccgcccgcctcggcctcccaaagtgctgggattacaggcgtgagccactgcgcccggccgagaacagttctttatcaggattctctgggatggagagagcttgcagaaagaaccatgatcctttgggccacttttggaggttgttctacctagcttttttttgaaaactgttatctctttatatgcacttagcttatactgtcattcagttcagcatagcaacactcgatcatatgccacattcaaagctctgagccaagcactgggggtgcagaggtggcgggcctccctctgaggagctcagagtcctatgttatcattagctcttcccctcttctagctgcaaagcaagccactctcatgcaaagcccagtgttccttttgaatctcctctgctgtccacaaggacatcacctgctacagagctctgtccctggtagatttctagcaaatttaagtcatcatttcatgtccctgtggctcttgggaatgagatattaaaaagcaatatttgtattaaataatgttgtcattatcttcttagaagataatggaattagacaattagacaatgttggaaataaaacgcctcctaacaatttctgtccagctagctggcgccctcatgtctacatgaacttgcaaatggctcgtctttagccagaatcactcttcctcgtgactaactgtagaaaagagaattcgtcttggctgtaagatgcctttggctaaaacgttttttgagattacaacatttagatgttcctttaaaaatacctttcattggctgggcacagtggcacacgcctgtaatcccagcactttggaaggctgaggcggtcagatcacctgagcccaggagttcaagacccatctaggcaacatagtgagacctcatccctacaaaaaatttaaaaattagctggatgtggtagcaagtgcccgtggtcccagctactcaggaggctgaggtaggaggattgcttgagcctaggaggccaaggctgcagagagcaccactgcactccagccgggtgacagagcaagaccccatctcaaaacaaaaacaaacaaaaggaatacctttcattgttatttcaatttaacaaattatttcacagttaatgtgtattttccttagagttgggagggaggactgtctaaggttgcgtctttgagtttttttttctcaagtacttggctgcatttccacacatctgtgggaagaaatcaatttctttgtcatcccagatgttatcaccagcttcgtgtgagatggctggctacacctgttgggctgatgtctgcattttgaataatcattttaagtaatcttttttcctcctgagttacaaagtgattcaggtattttaaatagaaaccgcattattttaagtattcttgacctaccagctttccaaaaataaatctgatgactgctgtgtctgaaagggtacatttgaaggagctgttttatataaatcttcagacctctaaaacttccttatttttagaaaactacaggaagaaaataacagggtgtgcccaagagttttgttttcttgattaagaatgatttgaatttcataactgcacagaaaaataaatgttttcatagtcatctgatatttctttataaacattctttttctaactgtaagcaaatcaaagcttagttgccagaaggtcacaccaagaagtaaaaaaaagattcacaagaaagcaggtgaatgggctgcatcccctgagtggagggaccttgggctctctactttctgtgcagctaattagagcacagtggaaacaggggcaggaggggcgtgcccgtgggaggggcatgcccacgggaggggtgtgcccgtgggaggggtgtgcctgcagcagctgccctggctgtgctcatctttgaggcagctgccacgtgggcacttgggaactggtgcccacacctctgtctgtctttagagctggctctctgtggtcatggttggggtggggagtcttttaggcaagatggattttaggcaaatctcctttggttttaagtggccacacaattatcacttcataatattttggcctgccatgctcatatagacttgaagtagcctggacacatgacattcttatttttatttctgagacagattcttgctgtgtcacccaagctggagtgcagtggcgtgatcttggttctctgcaacctccgcctcccgggttcaagcgattctccagcctcagcttcccgagttgctgggactacaggcacacgccaccacacctgctaatttttttgtatttttagtagagacggggtttcaccatgttggccaggccggttttgaactcctgaccttaggtgatccgcctgcctcggcctcccaaagtgctgggattacaggcatgagccaccgcatctgacctgcattcttatttttaaatatcaaatgattttttcccccacagttagttttttaatgcttaggtctcactcagtatgttgaggtttgggtgtacagcttttgctgtctgcccaatgctgggcgtggctgtgccaccaagaagcaggcaggtactcactgggggtcctgctcaaagccagtgcgggaagagcgcgtgtctttctgctgccgtagccgctagctagtttttagactgcagtcaacactcactggcctcagcagtacctgtggagccatagataatcattctgattcctttccacaataatactccacttatttgaagaatgttatcatgacctctaagctttggctgactatcattcttcatatgccttgactagtataacgatgagaactgcaggttcatggaaataattcactgacagctaaggtcaaggcttcctgaaatgggatgagattgtggcccactgtaatgtgctgggcctgtggataggtattctgtagagagggagctgtcacttgttcccctgtccctgcggttggcctgcttgcaccagttacccaggtcttctttcccttgaggatactgctctgggtcttaggatttcctcagtctctgtgagctccccagactctgctttctccttttcctttgatattttttaaaataggaagaaccggctaccatatcacacaccttcactgtggtgaacctcagcccataaagctggcttggttcatgttggatttactcttggatagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcgcaacggagaaaaactggataggaaacaataagggagcagcaagcagtaggggcatggccaggagatgatggtgcctccatatgattaaatgctgtgtggtctttaaaaatgtttgtgttactggtacaagagggaaaatgcttacgcattacattgagtcaaatgcaggctataaaactgtatatactgtatcatttcaactaaatagacaaaatttatgcaaagaagactggaatgaagtactgtatagcaaaagtaattcacgggttttttcctgagtaataggattatgaatttttaaatacttttagttagtttctaaatgttctgtggtgtgtatttcttaataagcagaagaaatttgtgttctaaaaaatcacttctttctttgcattgaatctgaggtcaacagcagggctcatggcaaatgtcaggaggccaggggtttactcacatgtgttttcaagaagacagggagtagtttggagttcaatcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttcccttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacagatttttagctgtgagaagcctgtgctacactggcacttaacactgatattcagaatactactcataggtaccatgtattgattgactaagggctggactttgcagcagacattttggatgtattcactcatttcacccctccacgtttctgtgaggcaactatcattgtgcccattttatagatgagaatgaaacctctgggaggtttagtgatttgcccaggctacacaagggctaaatctgggactggaccccagggcccggctggcatgttctttctgccatctgcattgcctcactgtgcatgcctctagcagtattccataagttagcattattcacattaaaccaaatatttaaaacatgaatataatttgaaaatcttttttcaaggtttaatttgatttgcaaagtgtgccaaatacactagatcatattcagcacatcattgtgtgaaatactatgttacggtctcttcacaagttttattaggtaggtgcaactgacaaattaaaatttttaagctcttggcagtcaatgacattaatgaataattaacttagttctttatcctggttaaccaaaattaaggagcaagtggcttttgctttttctcttgtctactgcaccttctccttacaaattggcaaattacagaaaaaaatcttttctcttttgctcttttagatagaacatactatagtttcttttgtttctctcattagctgccctctccagtttagatagatattctgtagtgatttatagaaaagggtttagtagatgtttgtagtttttcagagattaaaaaagacgtttcaaattttgtattatgaaaatgttctcaaatgtgtacaaaagtagaaagaagagtaccttttacctgccattctcatttatcaatatgtggtcagttttcattatgaccctctcccactacccctcaccccatattggattattttaaagcaaatctaagacgctatatcattttatctgtaaatatgtcagtatgtatttctaagatatagactcttttttaaagtccataatggctgggcatggtggctcatgcctgtaatcccagcactttgggaggctgaggcaggtggatcacttgagcccacgagttagagactggcctgggcaacatggtgaaaccccacctctacaaaaaataccgaaattagccttgtgtgatggcgtgaacctgtagccccagctatgctggtggccaaggcaggaggatcacttgagcccaggaggtcgaggctgcagtgagccgaggtcacacactgcacttcagcctgggcaacagggcaagactctgtctcaaaaaaaaaataaataaataaagcaaaaataaaaataaagtctataataccattattacacttaaaaattaataatttcttaatatcatttaatagcaagtcagcattcagatttccctaattgtccaatgaatgactttttaatagcagttttattgaaatataattcacataccataaaactgacccttttaaaatgtacgattcattgattattagtataagttgtaaaaccatcaccactatctaattttagaaaatttgtatcacccggaaagaaactcctcacccatgagcggtcatttccagttgctccctcctcccagtccctggcaactgctagtctacatcatgtctccatagatttgccaccttggatgttttctggaaatgaattcatacaatatgtggtcttttgccactgtcttctcccacttagcatacttgttttcagggttcacccatgttggatcacacatcattccttttcattgtcaagtaatattccactggatgcaacattttgtttatccatttatcaggcaatgggcatttcagttgttaataaattactttatgaaatcagttcattaatgtctttttccccatttatatttctattatattgaatttttaatgttacaggattcttgcactcctagacccatgcctaagaattcaaatgaaaacgcatggtacaatggacagccccatctacatgtaccttttgataatttcgaaacctttttaaagtgatgcagtaagagacagtgttttaactctgctgcagggtttcaggtttctggacagtagatacaaagtagcatgctctcttgttctgaaccttgctctttttacttagcagtgtggcctacaaggcattcctttgcagtgtctagagctcctcctcattccttttttttttttttttaggcagagtttttgctcttgttgcccaggctggagtacaatggtgcgatctcagctcaccacaacctctgcctcccagattcaagcgattctcctgcctcagcctcccgagtagctgggattacaggcatgcacctccacgcccagctaatttttgtatttttagtagagacgggttttctccatgttggtcaggctggtcgtgaactcccagcctcaggtgattcacccacctcggcctcccaaagtgctaggattacaggcgtgagccaccgcacccagcctcctcattccttttacagctgcacagtgctcccttgctaggagatgccacagtgtattcaaccagtccctgcaacaggctttggttttgcaaattgtgctgcagtgattggccgtatgcgtagggcattttgtatttttgccagtctctttaggacaggtgcctagaagtaggggtgctgggtcagaggatacgtgcacctgtgattttgctggatgatggtgatggtgatgataggaatctcctccagcactcagctaatcatctactttgtcttataacttagcaaaagcaggttgccttttccagttctaaatacagacatcttttaaattttgaaatggataattaggaattctagcttcatagtggttagatatgttaaaagtaaactttggatttcctcatataatcatatatgtaatcatgtttttaagcctaatgggagttttatatatcaaatagtgcacattgcattattgatgtgatgtaagttaaaagcatttcttgatcattagattataacttaatatcaaaaaaatgcattagtagatttggctagctttactagaacttctagatttattcatatcaactgtagttttgaaaatatattatcatggatagtgctttttgaagtctggttattctaattcaaccatttagaatgatgaaaaaaatttatttcaggcttaattatgaatgtgtttggacctgagatttttaataccttagttagattttcagttaccaaactatggagtcatattgcagggaatctaactcaaggtggtttaaatagtatgaaatataacaggaaactgctgagcataaataccgcacctgttactggaaaccagtcttcagcttggttgcccttctcccttcacttccagcgggttggtagggtctgttctcagagaggccaactcattgggaaactcaaatgttgctttacagaacacgcttctcacatgaatgaaagacaacagatttcagagtgggaagataccttaaggaacatttttgagcaaaggctttcctttatgggtaaggaaaattggacccagaggaccttgcctgtggacacctggctaggtggggacacagcagggactggcgccccggcccctgaatcccaggcctgagttccttcccctcctctccactacctcccccactctgccttggtgtaagcacaggaagtaagtggctggttttgggggagaatgtgcctagggttctactccaaatctgtgtacaggatatgcagcccatgggttctcactggctctgattctgcctctggtaccacttgaccatagcattttattctcttcacattatattcacgatacaaaattgcacccattgtccacaacagagcattttattgtcgggatgtagccaggggataatggctaccacttctagggtgtctactatgtgccgggcactgtactagaaacttcgcattgctcattcctagtcctcacagcagccctgcaaggtgggtgggcactctgaccttattttagaaagaatccaaggcgtgtgctgtgtcttccagctcagctgaggatgagtccagtcctgtctgccttgaggacccttgccctccttcacctgggcacctcttacccccagagacaggattccagccatcctgcaatccttccaccggatgcgttccaaacacagcgtttctcaggctcctttcatctgagaaattctccttttggtgctgtgtttgttgtcgtgttttgcctctaggaaaaagttaattttttttttaaaacaaccctttcatgaaccaaaagaatctctcatatcttagtgtcatctggaagctagggatccatttaccttagcacatgacgagcagaaaattgtgtttgaaacttccctgctgctatgtcacttctgcatttttaaagagcacttatctgaaaatgattcattacagctgctcctctttcctgtcatcttcaagatccaggctggcacctgttcagactcaacactaggaggtatttttccttccaccaggttttcttaccgcagcgagctttcttccttgagtggctaataatttttatacatggtaatgtgaaagaaacctggcgtgatggcatgtgcaaaataggtacttagtaagcgtgctggtggtgggggttacgatgctatttaatcagtcagtggttacaaaaacccaaggatgttatcaagacagggatgagcagcaattggatcttgccgaagttgggatctatccaacttctcagtcattccaagagtagtcagtgtgtgtccccctcccccttcccatccctctcctcttcctcctcttcccaccctctatttttctttcatgatctctcatcacaactttaatattctacttgcttctgatgctactctatgatattttaagatataaaatatacactctgggaatgcctcctgcattgcatctgattttcttttcatgggcttttaaaatcctattttctatttcttcttttgagaaaaggacaacaatagattattatgagattgaattttgaaattatcactcaagaaagaatgaacaacttagtagtaactccaaaatggcaacataatgtctgctcttagaagcaaggctttcgttactgaaattaaaccaagttacatttccagtgtatgttcactcccttctgtgtgtaggcctgggagcaggtactagcttcaaggatcctgcagtcagtggagtagacagactattggatttagcgttccaagtgtgatgacggtggccagggcaaggcgctgtgggagcatggaggaggccccactttcttttacattaaagagagaaggaagattggccctcagctttagggactggaaagttccagcaagttaaaaatttggcataatacacagttttgttgttggtaatattttaagagcctaaatggaggcagatttaattctatgatgaacaaaatctgctagcttttttgtttgattggagatggagtatcactctgttgcccaggctggagtgcagtgacaggatctcagctcactgcaacctctgcctcccgggttcaagcaattctcctgcctcagcatccttagtagctgggatgacaggcgcatgtcaccacgcctggctaatttttctgtttttagtagagacgaggtttcaccatgttggccaggctggtctcaaactcctgtcctcaggttatccacctgcctcagcctcccaaagtgctgagattacaggagtgagccaccatgcctggcctctgctagcatttttaaatgaactttttattttaggatagttttagatttctagaaaagttgtaagcacagaaggttcccatagacccagtacccagtttcccctgttattaccgtcttacattagtatggtacatttgtcacaactaatggatcaatattaatacattattattaattaatgaccatgctctattgggatttccttagtttgtcccttaagcccttttggttccaggttcccatgcaggataacacattatctttagttaccctggctcctcagcctcctccaggctgacagtcttccttgtttttgatgatcttgacagttttgaggaatacctgttagagggttcattgactatccttcaccttggcttcgcctgatgtttttctcatggatagactcagcttatgggctttagggaggaaggcacagaggtaaagtgccattctcatcttatcagcacatcccgtccaagggtgcatgctatcaacatggctcatcactgtggttgttgaccttggccatctggctgagggggtgttggtcaggtctctccactggaaagtaacttctcccccaacttcgtcatgtggctgttagaaggaagtcagtatgtgccagctacatttaaggagtggcagattatattttaccttcttgagggtggggtagccacataaattattcagaatacagctgtatggggatttgtccgttctcttcatttatgtatttacccaatcatttatttatatatactgtagcataaacttacagatactcgttgtgtactttgggttataatcgaatactatgttatttgttttgtggctcaaattgttccagctttggcctttgggagctctttcagttaggttttgtgtccgtttgacttgcccccaccaaaatagtgtcttttggttttgttgttgttgtctgagcacttctttactttctggcaccacagaagactccagattcatgtgctccctgccccagccgtacgtgctgctgcttcccctgaaggcatgctttcttctgctgtagaatggccttggaaaccaaggtttgggcattaggtgtcattgctttaggccctgtcagcagacagagctcagaaacatgtgtttatactaacctgtgtgtgtgggtgtctatgtatgtatttatacttacatgtctgcatctgtgttaagggaaacctgagtccacactgatgtctctactctagtggcacatggttcattcccgccatctgcccttgcttatccatcacctccctctccaacagtgagagacctgccgctgccatcctccatccttttatgtaattgttccatcctgatgttcctgtgtagtggtttcagaattgttagcctccacctttgtgggaagcacccttactaactagaatacagtgctgatgcgcagttcctgttatctttagttttacagtctctactcatttccaaaatgacttaggtcagcatcttcctgccccccactaccttcagtgaggttgtcatatgtttgtcatacaatcttcattccatcatggggtttccctgtctcctagatggttttacttgcatacttcaaggttcactcttggtgctgtaagggtctctgggctttgacaaggcatcatgtcacatatgccccatgatggtatcttacagaatagttttatcaccctagaagacttcctgtatgtcacctattcagcccctgccctgcaacctctgacagccacaaatcgattttctgtctttagtttacctttactcaaatgtcatataaatgcaatcatacaacatggagcctctcagacttgctgctttcccttagcaatgtggatttcagatgtggtttgcttcattccttttatcaccaactcatattccattgtatggatgggtcagtttgtttatctgttcacctatcagaggacatcttggtcgcttcccgtttttgacgattgtaaataaagcagctctaaatatttacatgcgggtttgtgtagacataagttttcagatcaattgggtaaatacctagtgtcagtacaattactggatcatatggtgaaactatatttagctttataagaaactgccagactgtcttccacagtggctgtactatttttcattcccaccagcaaggaatgagagttcctgttgatcggcatcccggccatcaattggtattttgtctgtctttttggatttcagccattctaataggtgtatagaagtatcgcattattgttttaatttgcatttccctaatgacaaatgacgttgagcatcttttcatatgcttatttgccatctgtatatgtcttctttggtgaagtgtcttttcagatcttttgcccatttttttaattgggctgtttgttttcttaccattgaatttgaagagttccttttatgttccttatacaagtcttttatcagatacgtgatgtgcaaatattttctcccaatctatgccttgtattttaatcctcttaagttcttttgcaaatttttaaaaatgttaatgaagtccaaactatcaatttttttctttcatggattgtgcttttggtattatatctaaaaactcatcaccaaaccactttcttctagaagttttatagttttgcattttaaatttaggtttatgggctgttttaatttttgtgtagggtgtgaggttagtgtctaggttgcctttgttgaaaagatgatcttggctgggcatggtggctctcacctgtaatcccaacactgggaggccgaggcaggcggatcacctgaggtcaggagttcgagaccagcctggccaacatggcgaaaccccatctctactaaatatacaaaaattagctgggcatggtagccagcacctgtaatcccagctactcaggaggctgaggtaggagaatcgcttgaacccaggagaccgagttggctgagattgtgccactgcactccagcctgagcaacaagagtgaaactctgtctcaaaaaaaaaaaaaaaaaaagaaaagatgatcctttctccaaggaattgccttcatacctttgtcagtgctgctggtgtttcaaaattcatgtccttttcctttctacttagcttatgttctgtaaaacagtggtctccagcctttttggcaccaaggaaattgtggaagatgatttttccacagaagtggggcgggtggtggggatggttttggggctattcaagcatggtacatttattgtgtaccttctttcttattatttattgtgtaccttctttcttactattacattttaatatataatgaaataattatacagctcaccataacgtagaatcagtggcagtcctgagcttgttttcctgcaaccagatagtcccatctagggttgatgggagacagcgacagatcatcaggcattagattctcataaggaatgctcaacctagatccctcgcatgcacagttcacaagagtttgcactcctatgagaatctaatctgatctgacaggaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgcctttaagaaccacggtcaacaatggcactgtgttaccaaagaaacctactggctctctaccatccccctccggggtcaggaaagaaactgctgtgccagcaaccaaaaggtgagccagaagcagggccttaaatgaactctcaaagcagttctctcttagattccaacatgagtattactttttaaaatgacattgtacaatttcttctgtgagttaaagcttataaaagtccaacattttatatggtgccataacaagaactagttaagtttattattattcttgttttagatttacttgtgttgcctttgaaacctcactggctaaaaccacagtgtggtgttttgtatttttacttaaagttctcttttgaaaaaacaaatgttagtataacctgggtaaaaataaatagctgttcccaagtccatactgggaacatggcaaaattcagattgccatagcaaccttagatttttctctatgcaatttggataagctcatactttcaaaatgtacccaacaatggagtctaaatattgatgttatctgtcacaaagagcacagtttgctcttaactttgctattattttgtaattatcatttaaagatttttatattttagggccaggtgcagtggcttacacctataatcccagcactttgggaggccaaggtgggcggatcacttgagctcaggagtgtgagaccagcccaccttaaccatttttaagtgtagagttcagtagtgctggccgggcttggtggctcatgcctgtaattccagcactttgggaggccaaggcgggcagatcatctgtggtcaggagttcgagaccagcctgaccaacaggcgaagccctatctctactaaaaatacaaaaattatctgagcgtggtggcacatgcctgtgatcccagctacttgggaggctgaggcaggagaatcgcttgaacctggaaggccaaggttgcagtgagtcaagattgcaccattgcaccccagcctgggtgacaagagcaaaactccatctcaaaaaaaaaaaaaaaaaaaaaaaaaagagttcagtagtgttaagtatattcacgcatctattgttgtgcaacagatctctagaactttttcatcaggcaaaatagaaactctagacccattaaatagtaactcccctctactctccccactgcccttggcaaccacctctctactttttgttgctatgattctgactacattaggtatttcctaggagtgggatcatctaagtagtgcttgttcttttgtgactggcttactttgtttagcatgatgtcctcgacatgcatccatattgtagcatgtgactgattttaaggctggataatattgcattgtgtgtatatatcatattttgctttttatcttaattttaggttcagggggtatgtgtgcaggtttgttacaagggtatatttgtgatactgaggtttgggcttctgttgatcctgttacccagatagtgaagatagtaccaaataggaagtttttcaacccttacccacctctctcccaccctccttttggagtccccagtgtctcttatccccatctttatcatattttgtctatacattcatccatcagtggctattctgtaccatttatctgcacatctgtccttatggccaataccctaccatcttgattactattgctttttagtatgttttaaaatcaggaaatgggaggcccccaactgtattcttctttttcatgattgttttggctatttagggtcccttgatattccatatgaattttaggatagtttttttctatttctgcaaaaaaatgcctttgggattttgatagagattgcattaaatctgcatatcactttgagtagcatggagattttagcaatattaagtcttccaatccataaacataggatgtctttctctttttttgtattttcttttagcaaagttttgtagttctcagtgtatgagtcttctaactccttggttaaagttattcctaagtattttatcctttttgatgcttcagtaaatagaattaatttcttaacttccttttcagcttggtcattgttattatatagaaatgcatctgatttttgtgtgttggttttgtacctgaaactttgttgaaattatgtattagtcctcacagttttcttctggaatctttagggttttctaaatataagattctgtcatctgtagaccgatagttttactttggatcctttcctatttggatgcctttcatttctttctcttgtctgattgctctgggtaggactttgagtactatgttgaataatagtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggagttgaattttgtcaaatgctttttctgcatcagttgaaatgatcatgtggtttttgtcctttattctgtgaatattgtatcacattgattgatttttatgtgttgaatcattcttgcattccaaatataaatcctaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaatgatttggaagtgttccctcctcctcaattctttggaagagtttaaggagcattggaatttatccttttttaaatgtttgatagaattctccgctgcagccattgggtcctggacttttctttgttgggaggtttttgattactgcttcagtctccttactagttctaggtctgttcatattttttgcttctttatgattcagtcctggtgggctttgtgtttctaggacttatccatttgctctaggtcacccaatttgctggcatatgcttgttcacagtggtctcttatagtccttctcgtttttgttatatccgttgtaatgtcctttcatttctaattttagttatttaaattttctgtctttctttgttagtctagctaagggtttttcaattttgttgatcttttttaaaaaaaacaattcttggttttgttgatttttttcctattgtttttctattctccacttcatttatctctgctctaatctttattatttccttcgctctgccaacttttggttttatcttcttcttctagttccttgaagtataaagttaggaggctgatgtgagatctgtcttctttttatgaaaactttgatcactatagacttccctcttagtacccctttcactgcctcctgtaaagttttggtatgttgtgttttcatatgtctccggatatttttaaaatttctttgtgatttcttctttgaccattgattgtttaagagtgagttgtttaatttaaagattgactttttattgtagcaaatacatgcatgcctcattttattgtgtctggctttattgtgctttagagataccacattttttttacaaattggtggtggtggcaaccctgtgttgagtaaatctatcagcatcgtttttccaacatgtacccacttcatgtcacattttggtaattcttgcaacattacaacttttttgttatcattatgtctggtatggtgatcagtgatctttggtgttaatactgtaattgttttggggcaccaaaaacagcacccatagaaggtggcaaacttaatccataaatgtggtttgtgtcctgactcctctgcccattgtttccccatctctttccctctccattggcctcccttttccctgagacacaacaatattgaaataaggccatttagtaaccctataatggcctctaagtgttcaagtgaaggaagagtcatacatttttcactttaaatcaaaagctagacatgattcggcttaatgaggaagacatgtcaaaagccaggatagaccatcatgtggtttagatgtttgtctcctccaaatttcatgttgaagtgtgatccccactgttggagatgggcctgggaggaggtgtttggttcatcagggtagatccctcatgaacgtattggtgctgtcttcacaataagtgagttcttgctctgagttcactcaaggtctggttgtttaaaagagcgtggcacctcctccccacttgctccctctcttgccaaaggacgtgcctgctcctgtcttgtcttctgccatgattgaaaactccctgaggccgcaccagaagctgagcaaatgccggtgccatgcttcctggacagcctgcagaactgtgaggcaattaaacctcttttctttataaattacccagccttgggcattcctttatagctgcacaaaacggactcatgcaggcctgttgttccaaacagttagccaagttatagatgcaaagaaaaagttcttgaaggaaattcgaagtgctactccagtgaacacgtgaatgataaaagaaaaaaataaaaagcaacatccttattcctgatagggagaaagtttgagtggtcagaatcaaagatcatacgaggcacaacattcccttaagccaaagcctaatacagagcaaggccttaactctcttcaattttatgaaatctgagagaggtgaggaagctgtagaagaaaagattgaagccagcagaggttggctcatgaggtttaagggaagatgccctctccataacataaaagtgcaaggtaaagcagcaagtgctattgtagaagctgctacaggttatgcagaagacctagctagctaagataactggtgaaagcagctacactaaacaacacattttcaatgtagatgaaacagcgttacattggaggaaggtgccatctagggcttttatatgagaagtcaatacctgacttcaaagcttcaaaggacagactgactcttgttagggcctgatgtggctggtgactttaaattggagctagtgttcatttatcattccaaaaatcctagggcccttaagaatgatgctaaatctctgcctgtgctctataaatggaagaaaacctagatgacagcacatctgttgtagcaatatgatgtactgaatattcttagcccattgttgaggcctactgctcggaagaaaaagcttcctttccaaatattaccattcatttacagtgtacctagtcatccaggagctctgatggagcggaaattaatgtttttatgctggctcacacaacacgcattctgcagcccttggatcaaggagtaatttcaactgtcaagttttattatttaggaaataacattttttttttttgagacagtcttgctctgtcacccaggctggagtgcagtggcgcgattttggctcactgcaacctccgcctcccgggttcaagtgattctcctgcctcagcctcccaagtagctgggattacaggcgcacaccaccatatccagctaatttttttgtatttttagtagagacagggttttgccatgttggctaagatgatctcgatctcttgacctcatgatctgccctcctcggcctctcaaagtgctgggattacaggcgtgagccaccgcacctggcaaggcatttgctgccattgatagtgattcctctaatagatctgggcaatgtcaactgaaaaccttctagaaaggattcaacattttaaaagtctttaagaacatttgtggggccaagcacagtggctcacacctgtaatcccagcactttgggaagtcgaggcaggaggatcacttgaggccaggagtttgagactgcagtgagccatgattgtgctactgcactccagcctggtcaacagagcgagaccctgtctcaaaggaaaaaaaaaaaaaagaacatttatgattcatgggaggaggccaaaatctcaacatgaacagggaagtttggaagaagatgatttcagccctcatggatgactctgaggcaattcaagacttcactggagaaagtcactgcaaatgtggtagaaatagcaagagaactagaattcgaaatgcagcctgaggataggactgagttgctacgatctcctgataaaactttaatgggcgaggaattactgccaaaatagtagtttcttgcgataggatctactccgagagaagatgctgtgaacactgttcacatttcatgacaataaagggtttagagtagcacacaaaccctgatgaagcagtggcagggtcgtgtggctggagcgtggggaacgtggcccgggctgtctggctccaaagcctgtgcgccttccattgtgctcggctgcttcccgcacagatttccaggtcagccctgacatctgctcaggaaaaacgcttgatataatgactgcttgcaaatcatccttcttttatgccccatcctgtctgtgtactatttgtgggagcaggagcagcagtcaggagtgagggtgactctcagcaaagatttctcagattgcaggtctgatgttgttaaggggatgtcggggccaaacaccaagtaaggaaacaagtcctggctatgaacagaggcctgggtcttacacccccacatttcagccacatatgaaagggctcctaggtggcaattactctcagcaattttatcttagggaagaagggagggaggaagggagcaagacaggaaggagtgaacgaacacgtgaaaaattatgcttagtagccatcgtgttatatctaagtgtgtacgtgtgtgtgctagcacttaaatggtaaccctcctcccagaaacattctaaggcctctgtagacttttccttataatttacagaatatccgtttgattactctaataagctattgtcagcatatagctgccaactagaaatacatatttttctagactgagtgtccaagactctgggttttgagtgaaagtgtagtgattcatgtattttggttcgtttctggcatttatgggcttcggtggatgggacttcccttccatttggaagctagaaataagaacagtagcatctaattgctactctgtggtaaagttcctatagatctctcattaggagagaattttgaaaacagaaagaagcaggctgggcattctgaatattaggattaaaataacttccaagtcatttcaaatatgtttacaatcaggtaggaatttttctgtaatcagagttccaaattaaatgagttggggcatctgtggtgtgtggatgggtatatgtttgttttcttttctccgggggtttttcagcctggtgcttaagaacaaaatcccctttggaaatagtccagttcccagcggttgtgctttgtgttgccaattaagacttcgattgagggcttgatttggaatccttgggaaaagctttgtttccattaggcaaaggaaaaaaggcagaaaatccagggaagacattgtaggtcataccttgctcagtggggatgcggaggctgacaatggagtaacatttctactggttcaagaaagagacaatcactgttctctgggctcataagtagagcatgacaataggccaagctatgtgaacagagatcaaaagaacaaaactggtacaaaaagcgttatttaaaaaatgctctgtgacaaatgtgagatagactggtaaatatctcttgcttccaaacaaacagccaatagtcctttggaaaaatagttccacttgttagaagtacagcatttgtaattgcactgaagccagtgctgggtacatagcgtgatttgaagaatagaaagccaaaatctggcttcagttgatttttaagaattatttctaatatatttctctattattccgatccattgaaacgtaggtgataaatccatgtttgagtctgttctcagtagcaaaatagaggtggaagtattgtcctgttgaacaaaggaagacctgcgggacctgtccccttatcagaagtgatatggttctccccactagctcgagtagttgactttgtattgtagaaagaaagacttatgtatatagaattctctaagattctcccagaccactagccttcctgaaaaatgacttggattttgccgaagatcagtttttagacagtgaaagatatgagcatttgttaatttaattactgaagtgcgttatctcagtctgtcagaattatctcctaatttgagggacaaaagccaggtgggtcctggtcccttgtggaccctccagcactcagcatagcgcacagtggatggttgatgcctagtaagtgtctgttgagcagatcactgcttttatccagtgttagtcgccccagctgtcaggacaaatgaaatcatcagaaaatctctggtcacacataagagctgtctgtcagatttctgttttggttgtaaaagtttgggatacttttgcaaaattttggaaaatcaatttttgattcccaatcacatgatgaaagaaaacctaattgtagcttcttatgcttagaattcttattaaccataagaagaaagacatctgtttttcttatggtcaccagtctccctgcagaaattttattatgtctaaagtgttaagtggcacaaattgttgaatgcatatgcaatgtaatataaagaaccatttattttcataacttacaaggttgcaggtttgggtgtgcggacagagagcagaagggaaaacaaaataagtggtgatgtctatgcatttctatacaaaaaatacttgccttaagcactaaaaaatatactgcattattgcacagtctctcacaagccagtacttctaccactttcaaaataaagagcattatttttcactcgccgtccagagagaacatagcttctttgatattccctgctggttatttgaggaggcttcctgcagtgagtgtacggtattgctctctctggctgcccttgttactgcaaatgtcttgtctttaagctttattttctgtccttcactttgagtcctagtaaatcctctttaattcataagagcccttggttctcaaaaggaaatgtcttgttttttattctacgtctgggacaacagtaagatttttttaaaaagtttaacattttaatgcaaatatgggaatgacaaatatcttggaagagttgtgaaggattatatccacgtctatatttgcgaaccaaaatgtctttcgattttgatgtgtgcgtcctgcaatttactgaagcttatcaaaatacttttccacgcttttattaattgcactcacatttattctgctttatttctgtgcctcttatatgtagattaaacagatctgtgagtcttctcaatgcttgcaaactgaatagatcgacaccaaggtgaggggaacttagatttactttgtcaccatagctgttccttccattgtttccatctctgttttaacgtagtagcttcaaggtcttgtccagtgcctaccattcatcaagtcatcaatcatgtaactatattaatcattgacatttattgtttttttagatgctcaactggtcctccaaaacagtatactttggcggttcataaattgcagatggtgttaattaggggcctaatagagagaacacagggttgaagtcaccagccccaccacttgctgtaaccccaaacaagttgcttcacactcctgaattcggttcttcatctgtaaaatgaggataatgatattgctgcaggggatttgtgaggtttgaattaagtaatacagtatatgtaaaagtccagagtatgccttaaacgttaactgtggctgctgctgctgcagttttcatcactggcacccccgtgaactcttccagccaccaggttgagtgttaattattagaaaatcagttagtgtttgctgtaattgatgaacagttgtggtttttcagctctttaagggtgttttatacagttctttaagttgctatgaacttgccatgaactcccacaaggacgccccagaagctgtgctctgggctcttcttgcggctgcaaaatctcccagggccccggcagctggttgggcaaagtgtgcatcagagccttgtactaaagactgggcggagaataatcctgctaagtcaaattagcttggtgtttgtcgtcatgggaacatcttgaacttgaagcacaaaggctcctataatttttagactttaatcccaaatttcagaaatgtaatgctctcttaaaatctgtaatttccttgtccccaaattgagcattctaaaaacacacattttgaccttaaggcacaccctgcagattgcagttgtaagattctggcactgtccactcaggggttccccagttaacaaaaagactatgtggaaagtgtattcagataatcaccctgagagtgatttcaaagccagcataccatgagggtttttaaaaacctgcttggagattactaactgagccactggaagttgcaaaggaaggaagagtgaaagttgagctaaggagggtgtatagacagaggagacagagaggggaaggaaggaagagaggagagagtcactggctaccaagaaggagagtggccagccccaggcaggagctgcctggatgggaggcttgtcatttacttatgaggagggaggacgttgagcttcagtgcaggcgcaggggtcttgctgtgttaagttcctcagctcctgcgtgctccttgttgagatctggtccccgtgcacccttcactgaagctgtgcccactggcgccgcctgagactccccacttcccagggctcaccccctcctctgtgcagcaccagcacatttacctaatcctgcgctagcctttgcgcaccactccttctctcctggtgtcgctgctacctctgactcctgtggtagcttctcagcccacgtctttaaacattagtttccccagggctcttctgtccttggtcacctcctccctcggtgatttcctctgcatccgtggctcagcacccgccagatggatagagtctgtcctgagctgtctcgcgtgttgcaggcttgtattctcacccacccacacctccagctccaagtgtcaagactagagccacccaagtctgtgtgtgttcccagagccctggccctagaacagccccctgcctgcccctcccctcctccttttttgcttacagagcaggtgctgcattaaagcagtttgtgtctcttctggtgacagggtcagtgtgtgatacttccatttatttcatcctttcatttaataaatgtgtaccaaacttttgtatagggctctgcaaagctacgaaaatgataaatgagataagatctcaagaaatgcgtggactaatgatgtagatttttaagtatgtacagagatacctatactagagttatgtgctctgtcttagtgagtttgggttgctgtaacaaagtccatagactgggaagcttataaacagcagaaatatatgtctcaccatcctggaggctgggagtccgagaccaggggggccagcatggtcaggttctgatgagggctgtcttccaggttgcaggcggccatcttctcacatggtggaaaagggtaagagagctctctgggcctcttccataagggcactaattccactcatgagggcttcaccctgctgacctcatcacctcccaaaggccccaccccctaacaccatcacattgagggttagggtttccacacatgaatttggggaatacaaacagtccatagtgtgctctaagaggggaacaatcagcctccactccatacctgggctctggtttacccctcatgcctacgaatcccctgtgtataggggatcccttctcctagagcaggctctttccatctgtgtcataacaacacattcaagccattcatttgatctttcccggaatttcgcagtctttgggaagacttccccaggctgccttcccaggcctctgagcactctagtccctcttgtcctatgaatgaagttggccgcttaacatggacaccacctccaaacaaaggcattgtacacagggtggaacgtttctgtcgttactcgtgacgtcctgttagcatttgtcccacgcctgcctttaggccagatttcttcaacctcagcactatcgacgtctggggccaggtgctactttgtggagtgagccatcccgggccatgcaggatttctagccgcaccccgggtctccacccactacatggcagtagcagtccctccccagctgtggcaacagaaggatgtcgccagacattgccagatgtcttgggggcaccatccccccgggttgcacaccaccatctggaccaaggttgtccaacccatgggcccatgggccttgtgtggctcaggacagctttgaatgtggcccaacacagatttgtcaactttcttaatactctattttctttgcaattttttttttgtttaattcgtcggctatcgttagcattagtatattttatatgtggcccaagacaattcttcttccaatgtggcccagggaaaccaaaagattggacatccctggaaagtgaagcctactcaagggcaggattgcttccctggaagcccctggagtgctctcacacggtactgttgaagtcttaatgcctcagtttctccatgactgtgaactgtgctagtggcctcagttaaaaaggcagagagagagcagagatgttattctatgtgacactctgaaaagctttttgatctccgttgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcaccttcgatttctagtacactctcctgacctttttaagttcattttaatggactgctttaagtttgtcagcagtattttctgagacacagtggctgaaaagttgtaattttatgatttatcagaggctatgtttcatattgatgctaacaccagaaatgtgaaccatttttctttatggtttcatgaaatacgtggactccaaatttttgagtttttctatgaggttagtttgtaatggattatgataagtatcagtgaaactaatagtaacattttgttcctgaatgctgctttttggcattttagcagcttgttttgtgtctatataatatatttatatctatataatgtactttgtaaagaaaatccagtttctctatgtatttttacctaacattgtactttgttctcactttttaaacattgtactttaattttattctctctgtttagtaaagctgaggaaggaatttcagcttcagaggctaagcatgtgttttttttcccaaatgttcatgtaaggagaaggcttagtcataaagcaatcgactccaacccacaggctataaaacttccaagtttgtaaatccatggtgattcagtcctataaaggaagcttaaactctttttcagttttattcctaaaagatgtctgttgtagaaaacatagagacacttctcacatctataacaggtcaggtccacggtctattaacaatttaaaaaaccattaacatgggttctgtcttcttctcatttagactattagtacttcttatcagaagattatgctaatggggtgataataccttggaaatgaggccaagtggttacagtggcaacagagtgtgaattagtgggaggtgcaacgtagcccaaagcttctttgaattcagggtaagcttggaagttgacctgaaatgtctagatcttggcagttcttagagacttggctcctcctctgcacatctgatttttattaagaatttccaaaaagaatctgcattgtgtaaactccagatccattttatctttaaaatcctatggctttggtaaatgtgctgggtaaatatttccatagaagatatttacaaagagatttttgagaaatgccacagtaggaaattttgatttggaaatgagggactgggaaaatttactaatcatgttcccaaactaattcaggcaactaaacatgtccatttaaaaataaattctttgtcttgttagaacccaggcgtggttgaggcgagcatagcacagagctggctgagtttcatgcatcatgcactgaaggggtttcagagacagttactgtctcctcttaggcaattgctggtcttgacagggacccataggagtaagagctgcagtaactcaaaagaagcagctaagactcggtagaagtgaaggttaagctggtaattcagtggctgcctgaccccttcccgcctttcttcctctgtattcccacgtgcgcagccccatgctcaggctgccttgaccccagcaccaaagcagatctggagtcttgctgagaaatgccaccctcgaggatgggacacagggaaggaaaggagtagggaggtggcccccatgtaatttctgtttttaaacattactgcgttcagtggactcaagatggcatgcctcgtccccatcgctcactcgacatgtccattgttcctgcaggctgtcctgtgatttaaaaaattgcccttgttgggttcctgtaggcagcaagacatggtggaaagggcagaggctctgcagtaaaagaaagatctgggtgtgtatccagttctgccttaatgtctccaagcctcagttttttcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaagtaatcagtgagattttctacaattcctcactttttattttcctcatttgtaagatgaaagtgttagattttgtcacaatccgcgttgcacttgtgtctaacgtagttgggggaaataaagtattataaatccttgtgaagctcacagttcttaaataaggcatcgggcgggagctggtctgtgggctgcttgcgatcccagcctgcccgctgttccagagccccattctcttccactcaggaaggctagttagggtgcatgtgagtgagagtgctgacgtcatagggatggcttccaccctgtgctgctttgtagaagaagcaaatcattcacacaggcagtgctttaacttgcagccacaacagattattagccataaagctcacagcttctcacacgccatgtgcaaagctgtcgttagcacatatggcacttaggcgcaaattagaaaaaggctccctttacttcagaaaaacagttccatctcagcactatttctcaataataatacttacagcagatagaaaaccattctgtataaattatacaaatcttactattgaacacaaaataatagtgtttgtggagtcctaaatattaaccttttctgagatactttattttaaagtaattacatgttttgctttcataaaactatattctttttctttttccttttttttttttgagatggagtctcgctctgtcaccaggctggagtgcagtggcacaatctcgggtcactgcagcctctgcctcttgggttcaagagattctcctgcctcagcctcccgagaagctgggactacaggtgcgtgccaccatgcccagctaagttttatatttttagtagagacggggtttcaccacattggccaggatggtctcgatctcttgaccttgtgatccgcccacctcggcctcccaaagtgctgggattacaggcgtgagccaccgcacctggccaaaactgtattctttatgatagtttcagtcttcttgctcccatgtctcattttctttacaaatggtcactggatttgagtctttcttgtgatatggaagacctttatcttagaatgtttaattttttcaaatactttgtaacaagccacaaaattttaacagcatttaatctttgcaccaacaaaacctctattaaaaacaaaagcaatatatggtagtattttactttatgtattattgatgataaatgaacgttaataattacatagtgattcatgtcatcatgaaatactacatttaaatagagaattggcaataacatcgtgatggaaggcttgtaaaatgtagccagtgaactaatctgatggagatatttttcaattaaaaaagtattttatacctgatagaaaattggctgcttatttagaagcacggttcatgttagatgttgctagattgataaagcatttcaattatcaaactggttccccttttgtaagtcttaagggaatgagctatgtcagctctataagcaagacactgtttcagctttactgaaagttgttgaaatgagttgattttgttagaataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaaaaaaaaaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagaaccactgggctggacaccttgagcgcctgtcctttctaaagctctagcatttggtgactatttcatctcagggctcttcagggcgcaaagttgtttttcctttacgatagcatcactgctgccgtcggctcaacagtactccttggctggggctctgggcccttcatccaccagctcctcattcccttttgtgccctgacacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatgtctttgtgtgaataaatgcactcttgcaatgttattttagatgtggttcatcatgtttccagcccgaagtacttcagttggacgtttaagtaccaaacaagtttcactaatccactcagaccaggccaccatctagaacaatgcccagcacacagtaggtgctcaacaagcattagtcgaatgaatctttttgccctgatcactataacaaaagaaggttaaaatgatgggcctttattgccacagccaagtgttaatcccagctctgctgctttgctttgtcattgtgaacaagtgacttaatctctttggggttttcctcagtagcagtaaaagtggtacctgcctcacagggtgcctaagatcccatgcataggagcctcagtgcagagctggtctgcggtcggctcgccacagtggcagctgtgagtgtcatgtctgcatcccagactgttggagttgaggcctgcacacttgtgtccctcccactcccctgcttgcagggctttttttcttggggatgtcttggaattccccagcgcctgtttctgtctttatcccagcctgaaaagcgaggaatcagaaattctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaaggaaataccagtggcccttaactcatgaataggcaatcaagcccagacctaattaaagacatgccgatctaagtaagaagataacatatttagaaaattctttttactttactataaaataaagcacagatgcagaaaaccacacaagcaaattcgtagcttaatgaattgttctaaggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgggagcctcccctggctctctagtctgagagcagtgcttttcagatggtgtcgtaactgcctgttaactttatctgtgactctgtagctctcctcccttcaccatgctgcacacaccgcttgccctcccttaggctctggaggcccaggccgtgccattcttattctttgtatctctagtactttacacagcacttggtgaacatgagtgctcaataactatttgttgaatggatggaaggatattgtatacgatcaggcatcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacacagtgttaaatattggtgtatctaaacatagaaaagataccataaaaatacagtattataattttgtgggaccacagacatctatgtggtccatcattgacagaaacacccgtgtctagcccatgactgcatttcatttgaaagccacagccattcaagaactatgtaaacagcaccacctatgggtagacaattttaacaccacattttacactggaagatgagacttacgcattttttactgaaaaaaatgtttcactcttcaagccatggggtcatttatgttttaataaatttcaaaatgataagtgctaatattcttcatattgttttagttttgagactgttagctgaggagtctggaaatacaaaggtttttgcagtgaaaggaggaggaagagggaagccatattaattaataacatgttggacgcattgtaacatatcttatttaatcgtgccaataacctgttcctcacagtggttgtattcccatttttagattaaggaggttaagctggtggaggtgaagcccctcacccaagccctagaacacggatccagctggcctcaaaatctgtgctccttccaccatgttaagctgggaagtattggttggaaatgtctatgaagcagtcgcttttgtcccaaataaagtctccagcaacttctaaacattttgaatagatggttcttaaatgaccctatttctaataaaaagctgcttaaggacaatttttgtagagtcattatttccatggtggagtattctgacttccagcaggaactttatttcatcacgtgaagtcatttttaaaagcagtcatgtggctgagcccagtggctcacacctggaatcccagcactttgggaggccaagacaggcagatcatttgaggccaggagtttgacaccagcctggacaacatggcggaaccctgtctctacaaaaaatctaaacattagccgagtttggtggcatatgcctgtagtcccagatacttgggaggctgaggtgagaggatggcttgagccaggaggtggaggttgccgtgagccgagatcacaccactgcacttcagcctgcgcgacagagccagaccctgtctcaaacaaaaagaagtcatgttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacacatgtcaccacgtgtcgaagacctgcaagatctggccccagagccccctttcaggaacatggggttaggttagttaatgtagatgaaagagataagagcagatccccgctctgaggcacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatacgtgttcacagctgcctctgcggtgttgaccgcactggtgtctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgtgctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcatacagctcccgtcaacagactttgttgagaggccacggtggcttcaatgttctcttctggttatcactgcacatctgtgtgtttgcctttctatcagttgttcagaagatttgtcatcattttgtgggcttatatgccaagatttgcatgcaagagtgaaattacctcctcccaggcttgccttttagaaaaggtggtggtgcattggcaggagtaatgggttctaaacaaataagctgggtttttttcaataaaaactcaactttctaaaataataaaatgtagcagtagtatattttctaaatacagcataccacaaagtgatacattgtttagagcatgatttaaagaaatgtaagcattttagtaccacctgatacctcctctctcaatgaccttagttgttaacattcctgctacctaatctgttaatagaaatctttcattcttcctcttacagttcttcagtgtcgaaggtccacgagcttccctgtatgaagcgttcagattcccttgcggattttctctttgcaggaagaacatagttcataattgcttttttctgtctctagggcaagttctgaatttctcatttctgtgttcatagcttttgcatcattctacttttgtgatcaaagtcatgataaaaaaatagttttcttatcttttgattccatacctggcttccctttgattatgtttctgtaattagatttgcctcgtagtcttttgtcagctttccttctgtcctcacctccttctgcctgtaaatttaatcatatatgtgaaatttggagttaagatttcttctgcttctgcttagcacacagaaaatgacaagaatgtcacttccaccctaaaaatgagaacaattcaggtatctacagtatcatagctattttaaggccaccatggagctgaggacagaaagtagtataatgaactgaagtgttactgaaaagtggcaagcccatctgaggagggacaggccccacggctgcttttgtctctggcagagtggcggggagaaaaggggagccctcttagatgggagtaggaaatcacctggaggtgtagaattgggaaaggctgagtgtggactggcaggagagttcagagtcctcaggggctctgggcacacgagaaccctccccccgctcagacgcactccgcttttccccagacttccgtgagtgtgcatggtggattgggagccggacaggcggctgagagagacccacggaggcagaggcatgccaggaggaaagccgagagacgttctccacgctcagggcctggaactaagtgccaggcagcagctggccacccccgaaggaaggatgaggaaagctgagagagagccctttgaggggtgggtgtgtagtgaggtctggggacctggaggatggagagaaactccatctgcacaccaagccccacaccaggttcttggcagcagctgtgtgtgccccggggagaggcaggattgctgagagccgaccccaccaccacccaccaggcacagatccttggggcctgctgaaggctgaagacggagaaccaagaggaattccacaggagctccaggcctcacaccagggcagccgctgtctattgtccaaggccctgggaatatagccatgaacagaaagatccctgcccctgtggaattgcctcctggtgggagaaacaaaatgaaggcagggggcaaataagtgctatagagaaaaataaagcaggaggggcgggggctgtggcgagcagggcgtgaggagggtttcagtatggagcagcgaacatgaatccgtacgcacggctacagcagtggcctgagagtggctgacttcggggaggatggtccaggagggcccatgagccaacgcctgacacggagcctgctgggccaggttcccagaacagcagggaatatagtgaagggagatgagctctgaagaatacaggggtcaggtgcagattggatagggccttgtaggccaatgtaagacccaggctttcaggttcaaaggctgtgccatggctttttagtagtattttcaatgaccatagtttagagtttaggaaactaagcctatagcttacaaaactacttaaaacacatttgaacagagtaaaacacttttaaagcatcaggaaagtagtaggctctaccaccccaccccatgtgctgcaggaaattatctggaaatcaagaatattaatatagaatattacttactacatcttgggattaaggatagtttttattcctggtgtttttcattgtgtttcaagtcaaaaattgaggaataatattaggaatatatctgctcaagtttttgttttaaatacacacacacacaaaatgcatatgtaatcctagcagcatttaaggcactatggtgccttatgggttcactatggtgaacccagtgcaccccttgactcccgtttatttcctgtgtcgtcttttgtatcttaaagcaggcagaagtcagggaagctaagcagtgcaaagcatgaactttggagtcaaagttgaggtcaaggggtcacccccctccctgagctcccttggtctccctgtccctgtctggaatggagacggtgccatctccccaaaggtggtgtcatgggaggggtgcccctggcagaaagtagtgggtctgcagtggcggccgcctctccttctgcccccagggtcccctcgtggaagtttctcctgtgaggtgcttgctcctagggatgtccagtctgcctgcggctgtctgtccttaaatgcttcctgggtttggtttcccaagtgctgtcatggggtggtctcacctgctcatggtgggtgcccagggtgactgaagtcagcaggggtgtccctacctctcccaagagatggctgagctggagggtaccacaccctggtgttccccgcttctctttctattttatgttcacccacttgtcttccgagaacagccatctgcttaggaggtgagctctaaaaggcctcaccaaaagatcttttgtcaggaatttgctagttttaaataagttctttaaataatctgtcagaagagtgtagggaataaaaacaaccgtttttacacatttagacagggtcattcccttcttgattaatcacattttttcctccccgaaacacttacttgcagtcataaaaagcacaactttggtgataaagtgaggattgcaatctcttgcacctatgagattgtttatgattgtttatgtgtgttcctttttgcagtgaaattggtggtgtttttcttattaacgtgtataacttatgcagcatttgtgtggcagactactgcagccgtggctttggggtctgaagtgaatgagatgaaacacccacagcaccctttaaaaactgtttttcgtttattttcacagcaaacccaaggagcctgtattcagtgcaggtaagtctgatttaatttatgtatgggaacccctcactcactctctcagaactcaagggacagaaaagaagtagccagcttcaggggccagccttggacacacaggagctttggtttgtgcaggcccagatggagctttgtacctggaggttgaatggctcagatagtgacagcgagactgcctttaaacagtcataaagagcaaacccttcacctaccctctccaaaaccaacgtaagacatgccagtaaggaggagagtggaatgccaccacctatgccatgatggaatttctagattaaaaggtgtctgttgccttggttattccttccttactaactggattctgttatcaacatttgcatttctcttaggggaaagtttcttatgcatcaagttatataactgtctaaaagtagcttttctttttctgcctatgatctcctaaactgcaaactaatagttcatgtatatctttccatatatcttttttaacaccttttgtaataaggtagatgctgttgtctagcatcttaaccttatttagaaatgcatttaaaatgcaaaaaatggacaagtatgtaattgatgaaatacattcatttaattttaattgttctagttttttcttaagttcagaattaaaacataaaagtcaaagttgtgtatttatcagcatgtgctttagtgttcatttcattttcaggaagcatgaaattactcactgaaaatgtacttgctgtaagctcgcagggccacattgtgagcgcacttgtcaggatccctgaaccgtgtccagattttaagactggggggcaggtcaggtgttggcctgcgggctagtgagggctccgggctccggggcaggcaggccagccacacttgcagtactccaccgtctctttatctagcccttctgtctctgtctccgaaatcacaagggaaacgccgggtgacacactgcaaaggtaggcagcatttctgaaacctcatagctctctgagcaaagctgttacccaggctacagaaacctttttcatacaggcaaacagatgctctccttgtatgaaaatgtttttgtgttgcaaaccacttcgattcattttaagttaaacgcatccctgagcatttactcggatgggctttaataagtggctgtaatttggatcccaattggtattggctgactgcaggaatttttttttcatctatgtaaaccttaagagagctatagggccacccctggatgtcccactgtttgacttggtatcatgcactgctgctggcctcttcccactagcgcctttgggtttggtggcgtgtgtgctgttatcctaacctgcctggaacaaacactgctttccctggctgcattttgattttagatgtagcctgtctgaatcaccagtacaaaacagtgccaaggctgacttcagtgctttttttgcctagttcagtaagttaaaattctgcagtaagtaagctcagtcctaaggtttcttaatcatcacatacctgtgatagactcatgtggatatttcatagacattggttatatacatccacactctgcattttttatgtgttgtggaaatagcattatattgtctttattcctaacctacattctgcgagctttctggcaggactgattctcttacaaagagagttgctagaatcccttttcatttagctgtcaactccagtctcctgcccctcttttcaagaatgtcaatcgtttgggtgcttttagattctttggttgtggtagccacacagcccctgatgagcttatatttgggtgaggtttaaggaagggaagaagcttcagaagagaacagcatgagcggtggcacagacaggacagggtgtagaggggggcaaagagacacgcctggccccagaggagaatccctgtgggtggctgtggcagatgaggtcctgtgcggtgagagcctggcagggcatttagacctgctggatccagcaaggaagagagcaggtgaagaagtttacatggaggaagggctccgtaaacctggtttgggccttggtgggtttggcagcagtgtgtaaactgacccaggagagccataagacagcctgtggtgatggggccccagtgcacctggggaagttggcaccagtgtgggagacattgtaaggggaggatccatgggacgcagtggctggcacacataggcagggatgatcgcgttcatgactctcactcaacgtcagccttaatacgcagtgtgaagagtgtgtcacgtgcatgcatttaagacctgaagcgcatacacacaataacatgaaactggggtgccctcttgatttttaagtaatactgcatgtggcattgtttgaaaatccttaagaataagacttataaaactaacttgtactataattatttcctaactgttcctcgccaatttcctccctgcggatgctttttctgttgagttgtgtacaggtatccctggttccaactgcccagtttaaataccattaaaaccaggtcctttgatctgcagtgaaatttcagaattcagcgagttctgaatctgaacagaattcaccaggagcggagctcacaagacattttctttgcccttatcatatcctgagaactccagtcagaacaccccaagatgttctttttgaggtctaggagttaccccgtgttgatacgttgttgatatttacttttgtccctatgatttattgaaatattaaaagttattttattatagaaatgttcgttctgaagagttttgcatcctgatttctctctctaatgggtcttttgttcttttgttttccatttctagattttctttgagcattttcctttctgcattgcatcctagcatgcacttctgctgattttgtgttctttacacttgaaagaattgttcagttaaaagatacataaagatatatttttacattgcaatataacaaatccatttaaatattgaaaaatatttgtgaatttggatattgagattgtgtatacattgaactcaaaaactttaagtggatttcttgtgttagttgaattttgggggtggtattttttcccctcctgatgataaaagaaagtaaacagtaaaatctcatggaaaatcattgttggaatcaagttccttcctgccttttacaatttcgtaggtatctcatgtacttaagtaaacagaatatcaaaagcaaacaagatgcaaacttttgtttcaaactgtttatttttatgttacttttttccctaggatatcaattagaatgacagaagggtaaaagtttctcttttatactgaaaggctagagaggataaagcatttgttttcaggtacgctgggcactgaggtatcttactgaaatctttgttctttttgtagaagaaggctatgtaaaaatgtttcttcgtggacgccctgttaccatgtacatgcccaaagatcaagtggattcttacagcttggaagcaaaagtagaacttccaaccaagagactcaagctggaatgggtgtatcctttattcattgattaggtctcacatgaagttatcagtcaatcaatgcttgatgttaactgtagaaattcataaaacttaagtcctcttaagcttttaaaaaacaaaatgttttactgttacttttgaaaacttaatgtaacaaaattgactatatgttagagacctacagagttctaacaaagtaggagcttcataagagcggcttattatcaggagaaccaacttatcattcctgaacgaaatagctgtggttctggctcaaatacatgttcattattttgctgaaaagaaaatatgaagatgttatatgattgtatgagtgatttttttctttgtcaggagaaaatgaatcactagtttctggtccgaattttattctttccaaaagaatgacaatagtagttagaaatatataaagaagtgaacagtgaaaataatcaagaatgggtagaattttagattctaatgagaactgatttttttttaagagatagtctctccctatgttgccccagctgttcttgagctcctggactcaagcaatctgctcgtctcagcttcccaaagtgctgggattataggcatgagccaccatgcccagccaaaagccaattatttttaacaggagctatcatatacttagtcaactcttcagggacagatggaaaactaggcactctctatatttataaggaaacaacagtgacaatgcaagaaaatattgtccttatgattgaggaaatgggagtatccaaaattgaaactaaaccacattggcaaaaaagtttttaaacccaaagaaagaggggtactctgaaaggaggactagcattctccccttaaaccaagtatggacttggccagccttaggagccaaacttcaagtgtgaccttgactgaagggatgatagaaaaatatgaataccaaagtactgaatgaagggagtcaagtgaatgacgtaaatgaaattgacatatcacgtagatatcatcctactttaaaaaaaaaaaaactagctacagggatgcatccctgtagtcccagctgttcaagaggcttagatggaaggatccaggagttcaagtccagcctgggtaacttggcaagtccctgtctcaaaaatacatatattcatatcaatcaaaaaggctccccaaaaatctaggccacaaaaatctgaatcaaccatataactaacgttcttgaaacagaggtgctggtagcttcatggcatgaggtttggaaaagtgagcttccaggggaaaaaacaactgaaagataagaaaatagaaactgtgaaaaaggtgaattaattgttgattatttttccattttcttattactttagaggaatcctgcagagaccacctttcagtctatgcagattttaagggaaaaaaaaaattttttttcaccttcaaatatttgagtacctgtttaatgccaagcctggaacacaaattataagatgttggtttaaatttaagctattgtgacttcatttagaataattactatttgagattatggaatcatattccttagaaattttttaaaattaccacctgtacctaaatttctcccccaaaatactttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaaaacatttattcagcctacttcctgttcatattttagaagatgtaaagcaatgaaatttgctctaaataaatggcatttttttggccattatttggcatcttgccgggttactttttacatccaagttgaagtgatattttgttctcaaaataaaataattttcaaggtttggaaatataatgcaaaaattttaacagggattcttatcccaaaggatctgaggggcctgatttttttttttttaccttttatgtatgtttgtgtgcatgtgtgtgtgtcatttgtaccctttgtaagtacttttaccatgtttaaaaaaggaattttttagtaaaaatttagctcgtagattacagtaaaaaaattaataattgactcaatagctttctaaaaataaaaccaaatcattgtgaaaatatgtattcacattacatcaatgactgtttcaactttactgcatgccttttgggggtcacatgtatttgtcatggaatatttgcaatttaatgttgtttaaattagtgatgctgatggtaatagttatatggtattttattgcctgtgcctgttgaataaagctgatgttttgtcagctcttaaagggaaaaaaaattttatcttgacatccacaaagctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtggtaagtcctgaaacaggtcattcctgcgactcagaaggcgaaggtaggaggatcgcttgaggccaggagttccagaccatcctgggcaacagtgaaaccctgtctctaaaataaataaataaataaatgtgattcctgttgcacaggtggaaatagcattagcagaacacggtcagtattgggacataactaaagagaaggaagagggtctgaggaaatgaggtctttgggagagctcttctgtgtggtctccttgtggtccgctcactactgcgctccgtgagacccctctcatgtttaattttccagcctcaccaacgcatgagcttcacggaccacattgtctcaacaaacagcgccacctctttggaggccttcttaacacatcatgtattaaaggcttctaatttgggtctttattttttgataaacataaaaatgtgttgcctcatgtttgtggctgagtcggctcttcccataattcatttatagcttttggtaggcatattacatatcttggaaggatggatgcgtgaagagatggatttatatatttgtatttgtcctggttccttggtcaatgataaaaatcctgttcacgaaagatggtatctttcctatttatgtactcaacatgactttttaataaagattgtagactaatgtagtggttctgagattgaaatggtattttcccagcagaggatgctttttccttcagtttgaaaattcttaagaagaaataagggaattaagatgaaatgaattaggtactagttgtctaacgtcgtggtgctcagagaatttgtcatgagtctgtaagaagttaggcattatatatttcttatatttaaatttttgactagattatatttgagcaagggaaaagtaaaacttacctgcaacatgtagatgttttgtaaatatccttttcttagcctagcagttcatcctgatcggatcacgatagcaacaggacaagttgcgggcacatcgaaggatggaaaagtgagttacgttaccttttcattgtttcataatgaactggtaacacaaagtaatttttagaaaacattgtgctgctgagtaaggctgcttagatataattatggtatctgaaaacttctgaacccctcactagaattttttattgtaaattagaagacttattgtgtggcagggtgcggtggctcacgcctgtaatcccagcactttgggatgccaaggcaggctggatctcttgaggtcagaagtttgagaccagcctagccaacatagtgaaacccgtctctaccaaaaatacaaaaattagccaggcgtggtgtcacatgaccgtagtcccagctactctggaggctgaagcaggagaatcacttgaacccgggaggcggaggttgcagtgagccaagatcatgccactgcactccatcctgggtgacagagagagactaagtctcaaaaaaaaaaaaaaaaaatactgactgtgaccttaaaaatccctggagctcatcttaatttcatcagatttttaaatagcattgttctgaacaaagaattcgctaattcttaaaatgtttatttatatgataagtattaaaaatatgaaggtaaacatttaataaagttaaaattataataataatttgaatgtacaacattttgccaaatttcagccaccctctgccctgtcctgtgaatgtcgtttaacagtcgtgactttaacccgtgaagtttgtgtctgtgtgcagtcacaaaagctactaggaggtttttagcacagattttgcaagcacttcagcaagactttaatttgcattttaaggcgttagagagggagcttgtagcttttttgatatctacttttatatagcttgttattgcataatattttatctgaaactaatttaagtacatacattttatcaacatgttttcatccagaaaaaatgaatactaccatatttcagaaaatattttagtaacattggattttaaatattaatcttatgctattttccattaatttttttttttttcttgagacagggtctcactctgtcacccaggctggaatgcagtggcacaatcacgggtcattgccacctctgcccccacaggctcaagtgatcctcccacctcagcctcctgagtagctgggagtacaggcacacgccacctcgcccggttaatttttgtatttttggtagagacagcgtttcaccacatcgcccaggctggtctcaaacttctgggctcaagcgatctgcccacctcagcctcccaaagtactgggattactggcgtgaaccactgcgcctgacctgcattaatattttatacttgaaaagagttaacagaaataatggaaatcagaccactattatgtaaataaatttacttaaattgaatgggtctttcaatttttttttttttaatgttaaatggctttgaaaaattctttgaaattagtggtaagctatttgttcctccctctagtggcttaaaagtatatttcagtttctggcattgaaattgaatcggtactttagaactagagaaaaatattatagttatctttcagtttacccatagagaaatccagagaggcctagtgaatgcccgcggacacccagctgcttagagattagactgaactagaacttggttcacctaacgcctgcctagtgtttctactaggtccaaggccagcaccttttcttactgataaatctactgattgctctatgatgttttcttctattaaggaagagaaaaattagcgtaaataacctaggaacacagttgagaggattttaaaccaattataacaattctaaatcttatttgtacataattgatgcctgttttgcccaagaatattaagctcttttttttttttttttttttttttgagacagagttttgctcttgttgcccaggctggagtgcagtagtgcaatcttggctcactgcaacctccacctcccgggttcaagcgatttcctgcctcagcctcccaagtagctgggattacaggcatgcactaccacgcccggctaattttttgtattttgtagagacagggtttcaccatgttggtcaggctggtctcgaactcctgacctcaggcgatccacctgcctcagcctcccaaagtgctgggattacaggcgtgagccaccacacctggtctgttaagctcttaatattatttggtggtgaccatcttatgaatttaggcatggtgacaccttagcaacaaaacagactttaaaagaataacccatatgtgagattccattttacttgtcatttttcatttctaaaattcagacacatttagatgcacaaattaaagtgtcagttcccatggtactattgtcaaaaattggccattcaaattctaaaacttggtagacctctccttactgttaaattatcaacaaggccctccacctcctgaagtcatcgggaatgttttatttacataaaaaggcagactcctgaaatgcagaaaaagatcttttgttttgacaaagtccgagttactgcccaagtaatcttgtagcttcaaggtaaagacacatgtgtatcaccatcacaattgatggctctgtgtttcttttctgaacagcaattgcccccacatgtgcgcatctgggattctgtgacattgaatactctccacgtcattggaataggtttttttgaccgagcagtcacctgtattgcattctcaaaatctgtaagtatgtgccctgtggatattgctgtcttcttccacaggaagtagagaatcaactcagggttgaagagggggagttgacacactcgatacctgcctgggtgtatgtacagatttggactctgaaacattcctgcttcccagaacccctcagtcagaggtcatatgcatgtctcatcagggacacacacttccttccaatcagacatctccagccacatgggtttggtgatgaaaacaggcccccagagatatcgtcctcactttccttaaggcagtttatgtgctctggccttgaatttcacctgcttctttcaagggtggctccagcgtgtctgtctctgccatcctgctactggaaaggggtcccgatccagaccccaagggagagttcttggatctcttgtaagaattcaaggcaagtccatagagtaaagtgaaagcaagtttattaggaaagtaaaacactaaaagaatgtctactctatagagcagccctgaggtctgctggttgcccatttttatgactatttcttgatgatatgctaaacaaggggtggattattcatgcctcccctttttagaccatatagggtaacttcctgatgctgccatggcatttgtaaactgtcatggtgctggtgggagtgtagcagtgaggacaaccagaggtcactcttgtcgccatcttggttttggcgggatttagccggcttctttactgcaagcggttatatcagcaaggtttttatgacctgtaccttgtgccaacctccatctcattctgtgacctagaatgcctaaccacctgggaatgcagcccagtaggtctcagcctcattttccccagcccctattcaagttgctctggttcaaatgcctctgacatttctcccctcccttttataagagaatccttaatcctaagggttgtaaagggacaaagatccatcttctgtaacttcttcgggctgaatagggatgatgatattcctgcctaactattagggtctcttgtatttggggtagagaagagctcagtcagaagacgtcagtatggcaaggtgatatctggaagattattaagtgttcaacttaagaaaacattgagtaagcttatcctgcattcctacacaaagagtgcaacagcaatatattccacaacagtaaaacaaaataaacaaaattatcccaagtaaactaagtaagaaggctttttattaactgggcaactattggaaccaagctgatatggggtcgctagctgattccagtgtgtccagaattggaatactgatccagatatttacattacccattgcttttatttcttctgagccgcagtcagagatcactggttggttcacaggaataagcagggttagtttaaatagcagaaaaaacttaaaaacgactgatgaaactagaatctaatgacaaatgtaccatagttcttgaaacataatttctgtctccagtctcccatttttactaaagacaaaccataacaggactgattagtttggaaaaataagccttagtcttgtatacttggcttgattatttgtataaagtgcagcaagaataattatttttcacataggctttttaaattggctttgatggaactctgttccataaggaatctcagataagaccttttttaaagccaagcccagccataggtttatattctcaaatacctatgggttgggtaaattcctctcctcttggggggtcccaagataacttggggctcctgggcctgtgagaaagtgacattctttacttaccacagatcaggaaccctgtacagggactgtggagacaaggtacaaggccagtttcccccaaggggcttctattgactctacaattcaatttgattccttaaaggaaagcatgccattcctgtgaaaaaaataaccagtttctccagttgtgtcctgttacaaacaaaaacaaattctttacaattatgcaattaactatattgccataaattaagaatactcacaaatagtttctaaattctggagagatcaggttgagagaaacaaatatgcttcaaattttgttcatagcagtatactttacttaattgttaaaagctctaaatagctcaaaagaaaagttttcttgtctttgaaaaaagcaaaggatcagcaacattttaagcaaagtcaaaaaagatgatttcaatcttctattagtttggttcatgcagttaactcctgttctgcttgatattcaggaacatttcagctccccatgagagtcctgaaagttttttcctctattctcatgttacaactttgaaagtaatcagaaacttgcattcaagagcacctgttaaaggcctatatctgattataagccaccttttaaataggaccaaaacaagacaagaattgtctgtggatgacagaaagtcttaggacagccacaattaaagccacaattgacaaggaaatttggttactcctggagcatacaataatttaacataacaagtacaactattaataacatacactaagtcatatcagaattataggagtttcacctaattttggaacacatgccagtaacatatttatacaaatacagcccaaagaaagccaatttcctatttgacaatgcttcctgtatgacttttataccaaataagccaaatttcacctttacattagtgtactattgatgttaaatattcttaacaaaatctcatagataaatctattcattttttttttttttttgagacagagtctcactctgtcacccaggctagagggcagtggcatgatttcagctcactgcaacctccacctcccgggttcaagcaattctcccacctcacctccctagaagctaggattacaggtgcacaccaccatgcccagccatttttttgtatttttagtagagacgggtttcactgtgttggccatgctgatctcgaactcctgacctcaagtgatccacccgcctcggcctcccaaagtgctggggttacaggtgtgagccatcgtgcctggccaatgtattcaattttaatcactgtgaccataaggtaagatttttataaaccttttattaatcctttacaatttgtgttgaaaagcagatcattgctcagagaaaaacctgttgtgcttttattccaatgtttaatttacagaaaaactgattaatacccctttaactttagccaatatgttcacacagaatttctttacaagattaatttctctcaaactttcgacaacttgcttaaactttgagctttattctatctaatttaaaacaataatttaaccttttaatctaggcaaaaaaaaatccacatttccatgccttcttataatctattaccaaaagacatttcactttctttatacaccttacatataaaacagtttttatttcccaaaaattacttaattcatgtgaactgaaaggcattacactttttacttttcttacaaaatatttgatttaagcttattattattattacaccaattaatcaaagctctttcatatataaacatcacacacataatacatgtaaatacacagacagaaaataaaggactcattccctaagccaggaattgaaccctgatcccaggctgccactgtgatggcagagaccaagataaagtactgccacgtgttacaaggtcaagctcccaagcacacgaaacaagataagagagaaactttatccagttttttttcaggaacctgccacaaaatttataactgaccagtttgctgtgctactttgaacagtgggcttatagggtcctaggcccacattctatcctatggtacccctctttatgacagaatgatatagaagacaaatttataacacaaagcacaacagattttctacagcttaagattaccctcacaaatccttttttcccattaatcaaaactttacaggagataaatagtgatttttaccattcattcagccagtttgcagagagagagagagagaaaggccagaagtctgactggtaagaaattcttaccattttgctggcatgccaggcttctgggttccctttccctgaggcggccctagtgatccagctggctgcaccacagccctaggggccaagccacatcataaaggaaaattatctttttctgtcctggccagagcaaaatatgtgtgacaaaacatagatattagccattcagctcagcacccagcacccaaaatcaaactggcagggctcagacatgcccctggtcggccccatcgttgttaatccagcctccaaccaggagcttcaacttacggtctctgggcaagatggtggccctgagtaatagaaaacataagaaagggaaaaaggagagagagaaaagcattccctgtggcagggcggggaaggtgaagagctcagggaggccagagaaagacctgcccactgcagtgacactgaaaagttcaggtggctgcctgttgataacgaagggatctttcccagcagtcccgtcagctcttaaatttccccttttggggaggaaaaagttccccatgtcccatgatcttgtacatgcctaattctgtcacccttagccatcagcaaagagtgcaaggcagataaacccaaagatgataatagcagttaacgtcccatagtgccaagcctgttcttagctgaaaaggactttactgagagggacctctaaccccctaaatcttaggaaggactctaaccttcctaagttgggcctggaacccaaggtctgtctagcgtccttgccttttattaagaggggcctttaacccactctgtcttaggagagactcctaagttaggcctctaacccaatcccatcctttgcccaggtgtgtgccccccccttacccaaaatcagccattcggtgtgtacagatgatttttctttgcatcaggggtctccagtatcatccctttggggttcaccagaaagatgttaccagaccccaccacttactaaagttagcctttggattggaggtttcctcagtattgtcccttctgtggtctccagaaagatgtcactggaccccaccacttacccaaagtcagcgtttgggttgggggtttcctcagtgtcatcgcttcatggtcaccagaaagatgtgatcataaaggggtcccaatccagaccccaaaagagggttcttggatctcacgcaagaaagaattctaggcgattccataaagtgaaagcaagttttttaggaaagtaaaggaatagaagaatggctactccatagacagagcagccccgagggctgctggttgcctatttccatggttatttcttgatgatatactaagtgagggatggattattgatgcctcccctttttagagcatatagggtaacttcctgacgttgccatgacatgtataaactgtcatggtgctggtgggagtgtagcagtgaggacaaccagaggtcactcttgttgccatcttggttttggtgggatttagccagcttctttactgcaagctgttttatcagcaagatctttataacctgtgtcttgtgccaacctcctatctcattctgtgacctagaatgcctaaccatctgggaatgcagcccagtaggtctcagccttattttacccatcccccattcaagatggagttgctctgattcaaatgcctctgacaatcccaacgtggctggcgggcagcctggctgcaagcaggggtcggacagggccttgtcatcttccaggcttcctcaggacgtgctggttcagcagacccaccctacactctttcaaaccatttcaaccacttcagaaacccatattcacacacatgtgcacgtgttcacatgaaaagacccccttgcactcaggcccccagagccgaggcattgtgcagccccacagcagccaccttcacagctgctaacagcccctgtgccatgcctgctgcaggcactgtctgctctaggaggggctcttgttttcatggaacccagtggtgaagagacaccccactggcccttctcttccccaattcctgtttcttcattccccatcatttacctgctctttctgtctggtcaagaaagcatgtctcagccaggcccagtggctcagccaggcacagtggctcacaccttctaaccagcactttaggagtctgaagtaggaggattgcttgagcccaggagtttgtgaccagcctgggcaacatagggagatcccatctctacaaataataataataaagagtagctgggagtggtggtacacacccgcggtcccagctacatgggaggctggggtaggaggattgcttgagcctgggaggtcaagggtgcagagagcaatgattgcaccactgcactgtgacctggatgacagagcaaaaccctgtctccagaaaaagaaagaaagaaagaaagcaggtctcaaaagcaatggatgagtattctttaactacaatgtagcagactctttattaaaaatgaaatttgatgtttatttttaatcatgttcaacccactttattctcagatatagtcttcctgtgaataactttcttttcagaatggaggaaccaatctctgtgctgtggatgactccaacgaccatgtgctctctgtatgggactggcagaaagaagaaaaactagcagatgtgaaggtcatgctccaagccttttttgggctgcattaacattttcccattcagagccgccctggcatagtggtagccccctttcagcgggctcattcccaccccagcccttgtgtatgacgccttcaccttagaatcgtttggccccgatccctgtcccatcatgggactttgaccccaggtcctgttagggttttttctcttttcgccatgtctgtaagattgttttcttcctcatttcatagccactacccttttaattcatccagtcatgtatttgctggctgttcctttcatttgcttggcacaccccgagtgcctgccacgtgctcgcacggcacgtggaggcccggaaatgtgctcaggcgtgaggtgggcttgctgcctgagcccctgcagccgcaggaagggcaggtatgggcaggggccgccagcacgggggctcctccaaagtggcacagactcaggaaagaccagcgggagccccgagctaaaccccaaatccttcccaacaggattcctcctgcgaggggccccttgggacttctttgaccgcctctaatccgttttgcacaatatgtcaaattcccttgccttgactgacctttttctatttctattttctattggaagcctatttttatagactcgaattcagatttctcatctttgcatctattaaccttagataaccttagtcacctaactttctctgctgcatgtctgcgaggcagaccttgtattctaaccaggtctgttccctgacacctgtgttcattccctagccccaccttctgatattctgggcaggtgtttaagttcttcttgctacgttgctaggttagaaggcatcagaggcaggttattatccaggctcaagaatgtgtaactgcattattaaatagaagcagtgatcagagcccaatccagtaggccagggtgcgggtcttggaggttagggtgtgggctgaaggtggcggaggtggcacctgaagtgctagatctactccatgggaccccaggccggttcactgagccacaggcagagtcccaggagtcaatcgcaggaggaactccctggggaaacgggcagccagagtcagccacgaacaatggacctttgtaaaatccattccagggccctccctggagatgacatttaccagatagggggtgaggcctagagatctgcattttaccatttctggtgattccatttgttcggccagactgggaacccatgactagcagatgagagcaaatgcttgcagttctgaagtccctctggtcccaactccctcctcagcaaagcatgctgcatgcccaccccatgcctggccctgggagaggccctggcatagacagaggactcctgggtgctccctgtcctcaagggctcattgtccagtgggggagacagacaaggaggaggtattaaggcccacaccagcatatgcttgatgtttttagcaagatggattcaatgggggaaataataggcattgtgcttgccttgaatttcttatttatttgtggctcacattttacttgttttcctacatgtctcttacgcgtcttaagagatgtgaggcatccgagtccctgtttttcctatagtgctctaatgaagctgtgtttgctgcggatttccaccccacggacaccaacatcatagttacttgtggaaaatcacatctctacttttggacactagaaggaagctcccttaataagaagcaaggattattcgaggtaaagttaaattatgatttttgctttatttttctctcgtatatgtgattggctagatgcatctctctgggggctctggtgatcaacacaatcccttgggatccctcacatagttgggaagcgtgtcacacctggtagataacgctggtaatgaagtgaagaaaaggacagagcaagcctgggtggagggcagggaaaggacctggacccagggagcaccaagcctcccacagtggcactggctgcagagagtatcagaagatgaagtcatcgggaggcaggcaacctgcctttgcaaaagacattagagactccctgtgccttttgtctggacgttgtggggctgcgagagcaccaggggacagcaccttttcccgggggtccatctgccaccacctccctgaggcttgtttcgaggacccctttattctggtgctcggaccctgccctttaggctgacagcatagccccacccttctccccggtcagtaccctcctccgcttgctgtctgcagctttatgattccccagccacttggggttgctagaaatcgctttgtcttagagcagttaatctcacagcagaagttatgtaatagtagacagaaatgcaaggtgtgcagggtggtcacagaagctgacactatccagcttgggaccactgcgaatctagatgttattagtacaaatgaaaggttgtctggaatatatatatgttgtatggattaaatatatatataatttttttactacattctacagaaacaagaaaagccaaagtttgtcctctgtgtgactttctctgaaaacggtgacaccattactggagattcaagtggcaacatcttagtatggggaaaaggtaataagtgattgttcccaaaaccaatggtttttggtaatgttgtaagagatcaaacatgagtgctttaagaattgtctattaatacaacgtacaggagtaggatgaaatttcaagttacagagacacacacatacatgtgtgcatgtgtaacttgaaaccacaaaactagaacagaggaaaagcggagaatagtaagagttactgaccttacagcattctgaaaggctctttaagcccaagctattatgatggaattaaatagctttattaggaaatcccctgacagattatgatgaaattaatgactacttataggtctgtaaaatatttaagttactatcctgatttatctagcatgtggcagacatttattgaaagctaattatgtgctagacactgtgaacatacaactgagtcagacccaaatcccctgctgtctgtgagcaaacagtttgctaagggagatgatgcatcactcagaaagcatgcgtccagttaagtccagtgagcatttatgagcacttaccccgtgacaagaaaaaagggaaaatccaccatcccttttctcaaggatcttagagtttgaattggggctgaaggtggagacggacttgtaaatgcaatttcagaagcattggtgacatttccagtatccctgctgctcttggctctaggtgtcttattcactgctcacttaatccttagaacaatcctgcagggtaagcagcagccccattccaccaagggggaactgagggtagagtaactaagcaatttgtccagagaaacagctcactagagagctgggatctaaactcagagcccacgttctcagccgcgtggtgcttcaaccatgcggcttcaacaatgcatattttccttcattctaaggtaacccatttcatgcttgtctggtgctctgcgaacgtctagaaattggatccttcatagattcatattgcaatgatgtgctcacggacaatattgcgttttaaaacctaagtcagatgagattagaaaatgggcagaggcaaccttttgacaatgtgctaatgatggttttcttggtgtgtttaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggaggtaagtcatcaaggctactgctaaaatttgtttttaaccttaaactgttatcctttttttattagtttgaaatctgtatcttacagttttgaaaattgtttaggtgaaatcacattatatgggagcaatgtattttattaaaatcctgaggcaggttaaatataactaataaaatagaattaggtttataaaacttgaggttgtaacacacttcatatttagaatatttttattctcaattttccaagggactgttacccacattttgatttattataaaaatctgtcttctcttttaactttttctttttctttttttctttctttctttttttttttagagcagggtctggctctcacccaggctggagtgcagtggtgtgatcacagtttactgcaacctccccctcctgggctcaagtgatcctcccacctcagcctcccaagtagctgcgactttagacacacaccaccacacctggctaatttttgtaattttgtagagatgttgcccaggctggtttggaactcctgagctcaagcgatcctcccacctcagcctcccaaagtgctggattacaagcatgagccaccacgcccagcctcttttaatttttaatttctagcatgttattttggagacattattgcattgagtgaactagtatttgttgagtatctacttcgtacatggccctcagctaagtgccaatgtgctccctagggctgtgactccttttgatacccggtgtacctccccattatctacttggcagccctgcattccggtaggcaccagaggcaagatatttaatattccttctgcccactcagtgaattttctcccccaggttccaggaaatcgtgagcagacactgcaaaattggcctcattctgaagggtgatgcttttcatccctagcttagaatggacagactttaggactttgaacccagatacacacaaaacacttatattttacatcagagagcaacatggcaccaccctctggcagtgtgaaaatttggttctgttgattatttcccttaataaaggaagatcttcatctgagctttggaaatcacttccccttgcctggagattctgttgtgagaacatttttaataataagatttgaccagcatttggttgaacatattgtgaattgctagagtcatagacatgcccaagtcatattataactgtaaagaaagctccaaagccccatctaatttcataaaagctattcactgtttgttagtatctgattcttcctcattagcatgggtcatcatcaacttgactcaaatctgtgctaacatgccacactggagaatgtgtgaggggaggctgcttctttcctggaacgggagagcctaacagcaaccgccagggtcaagctgcagcatttgttctttttatagtacaagaactttgtttcttcatcatagcaaattgttcttaatgggtgtattttgcaattctttctcttaacatttagattattccatatgtttatgtcgatttttaaactgaacagaatgacattgccaaagaacttaccattttaagttgtattatggcagtgttattattattattattattaattattattattttcagacagggtctggctctgtcacccaggctggagtgcagtggcgtgatcttcagcctctgcctcccaggctcaagtaattctcccacctcagcctcttgagtagctttccagctactacacgcaccaccatacccagctaattttttttgtatttttggtagaaatggagtcttgctatattgcccaggctggtctagaactcctgggctcaagcaatccacctacctcggccccccaaagtgctgggattacagatgtgagctaccacacctggcctatattctttactttctgaattgtatctactgttgctatcagaaattgtaaaaagtaaagagaaaactaaccagtagcattccttatttttaaattttgttgaggaaaatgctttttcttaacctcattcttgctgatgcttctaagatatataaaatgtttgtagtttaaaaataaggcttagggttttgatcactcactcaacagttggctgtggtatctgtttttttgagatggagtttcactcttgtcacccaggctggagtgtagtggcgtgatctcggctcactgcagcctccacctcctgggttcaagtgattctcctgcctcagcctcccaagtagctgggattacagccacccaccaccatgcccagctaatttttgtatttttagtagagacggggtttcatcatgttgcccaggctggtctccaactcctgacctcaggtgatccacctgcttcagcctcccaacgtgctgggattacaggcatgagccaccaagcctggccagctgtggtatctatgtgaaactctccatatatatgtatatacaacatatatatttgaacgtacattatatacatatgtgtatataaaactgttatagggactatcattatgataagtgttttgaatgactgagctaacaactgaatgaaattgtacatcttttcttttcatatgacttttcaatgcagattccagaacagtttggtccaatacggacagtggccgaggggaaaggcgatgtgatcttgattggcacaactcgaaactttgtcctgcagggcactctgtcaggggacttcacacccattactcaggtacgatcccactcagcaggcccggcaaacactctcattttgcattatatcagaccctaatcaagcattacaatcaggtgctttatactacgataaccttcctccaccccagagtgtctgtggctgctgaaagatgggaggagagaaactgttgagagcagttatgaagtcagcatgaagcctcggttcgtcatcccttacggctcctgagtgcgaactgtagtatctcagagcgcttctgtttgtcttggttatttgtagggtcacactgatgagctctggggactggccatccatgcctcaaaatctcagttcttgacctgtgggcatgacaagcatgccactctctgggacgctgtgggtcaccgtcccgtctgggacaaaataatagaggtaaacatgcacattacatttccatttttcttacagaaattcatctggaacatgtttatttattttttgcatgaaatcaacagtgatacaaagttgtcccaaagcaaatgttatttatctatttagagttgccttaacattgcaattgcatttaacagtgttacttttaacattgcctcgtggcctcagccatgtaattttgaagtttactgttgaaattttctgacaagaagttgttctttctgagttcattgtcagattttctgagtacagtctctcaaccatcctaagagctgaaaaatacttgttatgagcctgcattctatttacagtgtaccctttgaatgggaatttacaagctgtactaaacacacgattgaatatatctctacattttgagtttgatggtaaagtgaactttcgtttgaaagtcagctgggcacggtggctcatgcctgtaatcccagcactttgggaggccaaggcaggcagatcacctgaggttgggagctcgagaccagcctgaccaacatggagaaaccccgtctctactaaaaacacaaaattagccgggcatggtggtgcatgcctatactcccagctccttggaaggctgaggcaggagaattgcttgaacccggaaggtggaggttgcagtgagccaagatcacgccattgcactccagcctgggcaacaagagcaaaattctgtctcaaaaaaaaaaaaaaaaaaaaaagtcaacatctctgtgaattttgcaaaagaaactctgatgacctgtcagagtgttgaaatgccctttccccacgtgtattacttgagcactgactgtttgcatgccaagcactgtgcgtgtattatccttaatccctgtagcagctctgcaggttgaagaggttttttttttaactctgattttattgaataggaaattgaggtgtagagaagttaaataacttgccaaggtcactaagttagtgagtgacctagctagtgttagaacccagctcagtctgactcctaaactctggttctttccactgcattgcactgcagcgaatcggaagctcattctctgttgccggtgccctaatgatctgtgcaatcccattgcacagaggaaatagcccttctgtaaaccaacacatcatcctttcatcccccatagagttactggcatgtcccaggtgctaggttcaagttttggctcccttcccttcattttcacggaaggggtgctggtcactggtggccagctgagccgtgaggtggaagggcccaaggggcaggcactgccactcagagagcaggtgtggcccgtgatggcaggaaagggctaaagggaacagtgttatatgttctacctatgccctggtggtccaggagggctgaaggcaatgacagctcctttaccaggctgttaatcatttagcctaacataagggttggagctctaagctggaagccagggaactgcaatgaagttctagctcctctgcctactggccttgtgaccttggacatctgtaactcagtgtccacttctcaaaattgttacgaggcttagatgaatgacacagacagaagtgctttgtaaatggtaaagcttcaagtgaacacgatttctgtttgtgtattagtggcagctctgagcttaattacagctcccactgtagaaagaaagcattgaaataatgtaatcatatatcaagtttctttctcttggttttttagattatccagtggatctcagggcctcctattttcattcccattgctacttttcttcctgatcttccttaatctcttctctcttcatcctaaacactcctgcaaagtgccctttatctaaaacacatgttcaatcatgtcactctttttattgaaaggacaagaccattcaaagtgttcttatttcctagtgatcaaagtccttaccatggcagtgacatcactaatgtgatatactctgtgctgtaagcccattgacctatctgccactcctcaaatatgcccacagctgtgttgcttccatcacttttactatattactgcccccttcaccatggtccaaaaaacgactggagtggccacatctcaccttcaccagtgataattcttcctctcctgggaggcccaagtccagtcgtctgtaccgcgaagccttggcccagcttcccagtgtcacctcatccctccctcccctgtgtatctctttcatggatctctttcatggatcattccatcttgtatccgagttagtgatgactgtgtgtgtgttccactggatcaaaacctagaacatgccttgctcatctcatgatccttccaggcctccatagtgttttgcacccagtgggcactcacccagtctccgtgtcatggagttgggtgccgtggttgtctttctggagcaatcaagcacactattcagtgagcttaccactcagcacggggagtcaactgaaggggctgggttctataagctgtgactttgtagaagggcatttacctgtctttcatcagattactgtagaaatgagaggatgtaagacaaaaagggaaaaatcctaaaaggacagaaatttaagtcaggctcaatggcttacacctataatcccagcactttgggaggcagagacaggaggatcacttgagcccaggaattcgagaccagcctgggcagcatagggagactccatctctacaaaattaaaaattaaaaaattagccaggtgtggtgacacacacctgtagtcccagctgcttcagaggctgagccaggagtgtcacttgtgctgcaataagtcatgatcatgccattgtactccagcctgtgcaatagagtgagatcctgcctcaaaaaagggtgggggtaggtagaaatttagcattattgaaacgcagcattcattcaagcaggaaaacatttttctctagaaaagagacttttcaaatagagccatatagccctaaggaattagaagtgtgagcgtttgtgtgtgcacgcactcacgtgtgtgtgttttatgctatagtgttctatctgttcatcaatttacacttcctttaaaatattttaggatccagctcagtcttctggttttcatccttcagggtctgtggttgcagtcggaacactcactgggaggtaagtccatgccaacagcgcttgtgcttgcaaagcttatggaaaagaggcctgttgtttctatttccccaggaacaggcccccgttcagctcttggctacatgttcgaagcttctaatgacttaccaagaattaagttaaaagcgaaacttgaaacagtggcccattacattttgagccttggggaatctgaggaaagccatagaccctctctcctggaaaaggaccctctacctccactagacacacacacactttttttgtttgttttttgagacaggtctctccttgtcacccagactgaagtgcagtggcacaatcacagcttactgcagcctccagggcttaagtgatcctcccacctcagcctcccaagtagctgggactacaggcatgcactgccatgctcaactaatattttatcttttgtagagacgcaggtctcactgtgttgcccaggctggtcttgagctctagctcaagcagtcctcccacctcggtctcccaaagtgctgagatcacaggcatgaggcaccacacccagccacacacacattttgcctacaatctcgaggatttgtggagcttctcaagccctgatcttgaggctgtgggagaagccttgattttggaatgaagcaagaaaacatttcaaagtgctgagcatttaaaaatgctttttctactcctggtcacagtggctcacacttgtaatcccaaccctttgagaggcctaggcaggaagatcgtttgaggctaggagttcgagaccagcctgggcaacacagcaagaccctatctctataaaaaatttaaaattgagctggatatggtggtccacatctgtattagctactcaggaggctaaggcagggggatctcttaagatcaggagttcgaggctgcatcgcactatgattgcaccactgtaccctcgcctaagccacacagcgagaccccatctctaaaaaaaattaaaaatagaaaataaatgctttttctagctgccctttcaaaatttcaggaactgcccagaccctgagcctcatattccaattgagttaatacctattcacctggcacctcctacacaccggatggtgggtctgcgtttgcagctcagctttgccacttagcagcagtgtctttgagccggttacataagctctctgaatttgtttctttttctgtaaattgtgatattccctgcctggctgtgttgcactgaggatcgaaggagacagtgcacacagcacctgccagggctgcccatcaggcactgcaggggttattattatcattgctttccaggttttgattgaacatttatgctgctcattgtactgtatacatttactgtggtttcagtcaaatatttttcctcccacccttcctctctaaaaaagcgtagcacttaaattctgttgctatgactgcagagcctatatggataaagaaagtgtagccctttgcaggtcataggtagcaatatcttaagtattgggctccatgtagccaacagaattcttcatgaaaacgtttgtatagccacacacacacatacgcatgcacacagacacacacacacacacacacacacacacacacacacactccacctcccatttgactctctttgagacaggtaaaccttctaactcatcaggctcccaccttctgatgactggcctcccaataggctgacggatgccagcatgcctactgtgtgtgtaggacacggtgacagtgctcagaatcacagtgtcccatggtggaggagatggatcgggtcacctaatccagcccctcatctgtacctcttgccattcaggtcctaggttaggcttagctcccgatgctgttgatttaacaggtcacttcaaagccatgttctaatcagccccagcctttattaaggttaaatagcacattaaaggtaaatggttgttgaagatgcaagaaattggcactgaaaagcaaaatccacatttctggggggcaggacatctgacagtgcctggctaggggggctcctgtggaagacaagggacactcactctgcgtcagtggacatgctgatgggatgtcctcaggcaggttagaaactgcagcaacagtttatccatttatccttatccatttatccatttatcctgaaaacaccaggggctcaccaccaccccttgagaatataacaggcaggagagttcagtcattctgatgttaacactcatttagtgggtactgtgtgcttatcagaggatacaaagcacttccatgtccattatcattcgactttaatattgagcctgcagagtagacctgggctcttctccccatctcaccactgaggaaatggcccagcgaggtgaaattagaagaccagtcctccactccaatttctcccatttgctctgtgctttccctcgccctgttggttgcaggctagcatccccataaggcctgtactcttggcctgctctgtctgcagcaccattgggaacaccaccaccccggagttgtcccagccccatcctcctgcatggtcctgcttcgccctggaaacctgggtgagctcttgcaggtggtccttcactgcttcctctcaccatatgccctggcactaggtattggcatcttccctgcccagagctttctctccatgtgtaaatgacaaagcacaaacacagagaaaccatgtcatagtgttgataatggcatagttttgaatgctagccaatatgctgttcctttcattagaaaatgcttatatataggaaattttctttgaatgaaagctgggaacaagctttcttattaagcaaattctgagtatttattaagcttttatgattaacaatttttattcatcccactattatataatcttcattttcttattaaacaacttactgtgctttttctcatgttgataacaggtggtttgtgtttgacacagaaacaaaagacttggtcaccgttcacacagatggaaacgaacagctctctgtaatgcgatactcaccaggttagactccaaaccattcactactttatttttttaatcaacttttattttaagttctggagtccatgtgcaggatgtgtcggtttgttacataggtaaacgtgtgccatggtggtttaacgcacagatcaacccatcacccacgtattaagcccagcacccattagctgttgttcctgatgctctccctccccctcgcccccctccaacaggccccagtgtgtcttgttccccgcccagtgtgtccatgtgttctcatcattcagctcccacttataagtgagcccatgcggtatttggttttctgttcctacattggtatgctgaggataacagcttccagctccatccatatccccacaaaggacatggtcttgttcctttttatggctgcatattattccatggtgtatatataccacattttcttcatccagtctactattgatgggcatttgggttgattctgtgtctttgctattgtattcactactttaaaatcccaacagaattgagattctgtgtcagtgtctttaaagaaaaaatttcacaagcctcctcagagtaaaatttaaattagacatgcacataattatggcatttagggttcttttccctcctttgggtcactgtgcttgtgttatggaaaatttcaaacatagacaaaattaaacagaatggaataatgaaccccatgtactcatccgccagcttcaatgatgatcagctctcagccagtttcctgcgtctggagccccacccaccacccgcctcccatattctgaagcagttcccagacatctcatcatttcatctgttaataattgtatatatcccaaaaagatgaggactctttttaacagctttattgaggagtaatttacatacaataatgaaccattataaatgtacagctcatcgattctttataagcttgtggagctatgcaacaaccatcactacagtccagttttttaaccttttcatcatccaaaaagtttcctccatgcccattagcagttcacttccaccctcacccccagtccgaggaaactactgatctgttttctgtttccaaaaattgctttttctggacatatcgtgtaaatggattcctacaatatgtagttggttgcatctgacttcattcacgtagaatgatgtttttgagattaatccatgttactgtgcacagagcagtactatattccttctaattgctgggtagttttccattttatggatatataccacatcttgtttatccatgcatcagttaatgatggattttttttttttgagacagagcctcactgcaacctctgcctcccaggttcaagcgattcttctgcctcagcctcccgagtagctgggattacaggtgcatgccaccacacctggctaatttttgtatttttagtagtgatgggatttcgccatattggccaggctggtctcaaactcctgacctcaggtgatccacccacctcggcctcccaaagtgctgggtttacaggcgtgagccaccgcaccctggccttatggatttagattgtttctggttttttattattattaataatgctatgaacattcatgtatatgcctttttgtgtttgttttcatttctcgggtaaattcttaggagtgaaattgacggattgtatggtaaacttatgtttaacattttatgaaactgccagactgcctgtcctattttacattctcgtcagccatgtgctagggttctagtatcatcacatcctcccaatacttgttattgtccttttgattatagtcattctaaagagggtgtaatggcatctcattgtggttttaattggtgtttccctaatgactattgatattgagcattttttaatgtgcatattagtcattccaatatcttctttggtgaaatatctattcagatattttgccaatttttaattgggctgtttgtcttactgttgagtagtaagtcctctttatatattccgtatatacagtctttatcagatagatgatttgcaaatattttttctgaatgtatggcttatctttttttctgtttgtttgtttttgagacagcatctcactctgtcacccaggctggagtgcactggcatgatcatggctcattgcagccttgacctcaggtccaagcaatcctctcacctcagcctcccaagtagctgggaacacaggcacacaccaccacgtctggctaatttttgtatttttgttagagacagggtttcgccatgttgcccaggctggtcttgaactcctgggcccaagtgatctgcctgcctcggcctcccaaaactgctgggattataggtgtgagccaccatgcccagccttcattttcttaatggggttttttaaagcacaaaagctttcaattctgatgaagttcagtttatcaatttttccttttgtggatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcagaaatgtaaaggtttatttccggatactcagttctgcccccttcacctgtgtttatccccgattactgtgaccttagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgtgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcctttgttaaatttattccaaaataagtgttttttttatgccattgtgaatggaattgttttctgaattttgttttcagttggttggctgctagtatgtaaaaataggattgaattttgcacgtagatcttatatcctatgacctttctaaacttctttgattagttttagtataatagtccctcccaatccacaggggctaccttccaagaccccacacaggtgcctgaaactatggataacaacaaatgctaagtgtactatgtttcttcctatatatacttgcctatggcaaagttaaatgtataaatcaggtacagtaagagattaatgacaataataataaagtagaacaatataacaatatattgtaataagagttatgtgaatatggtttctctttcagaatactgtattatacgtaatatttgcagaccacaattgaccacaggttactgaaaccacagaaagttgtttcagtcttattatattatattaatatcactacattttattaagtttcttctgtttttctgaggagaaaaagcattcagtctttcatcatgagggataaagatgccctttatcatagtgagaaagttcccttctatttctaatttgtttggaggttttagcatgaatggggttggagtttatcagatgctttttctgcatctgttgggattattatgtgggtttcatccttcatcttattttattaatatcactacattttattaattttcagatgttgaaccaacttcacattcctgtggtaaattccccttaatcatggtgtataatcccttttacatgtgtttgctaggattctattaaggatttttgcctccatgtttctaacagatattggtgtatagttttcttttcttgtggcatctttgtctgtctcagttatgagagtactaccggccttacagagcaaattaggaagtgttctctcctctgttttctgaaagagtttgtgaaaagttggtgttatattaaatatttgacagaatgtatgtgaatttggtgaaactacctgggcctttctttgtgggaaggtttttaattactaattcaatttctttacttcttacaagtctattcagatttcttttttcttttttttttttttttgctctgtcacctgggctggtgtacactagcacaaacacggcacactgcagccctgacctcctgggttcaagtgattctgccacctcagcctccaagtagctgggactgcaggcaggcaccaccacacccagctaattttttttagagacagggtattcctatgtctctaaactgaaactcctgggctcaagcagtcttcctgcctcagcctcccaaagtgggattacaggcaggagccaccaaatttctcttttcaactctatttttgcttcatgtagtttgaatgaatgattgggcagaggttatgcacaaataacttaagccagtaaggctccgtcctctgccagtggctctgtgggcaggttgaagggcatgttcaaagttcaggccgtttccatgtcggcctggcttttactttccactcacccttttacatctcctctatgcacatgtacagattcagattggccggaagggtgtctgaataggcaggatcctttcctgcctccactgtgcatgcaccagcctcccgtcagccaggaatgcgctcacccatccaataaccgtaacctcaagccagtagaaaccttggccctccccacccaactgccctagagatggtcacttccatcccagtgctactattgcccagggctccatatggagtgagcccttttaccacagccgcgtggtcctcagagcctgttcttccctgccaggaccgctgtgctggcccagctgctgcgaaggagtgagggcagcccagggaagaacatgatggattcaccctgtttttacctgaagttgagaagattttcaaataaacaacacttctcagattttcatgtcttgttcaatttacagagtctggaaatggttgtttttgtcagttttatagaatttcataattgctttatggggagaggattggccaaccttctcatttggccacagctagaagaactgccctcttattttttgtgttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccactgcccctggcagctcttattttttttaatgactgttttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtagctgggactacaggcatgcaccaccatacctggctaattttttgtatttttagtagagatgaggttttgccatgttgcccaggctggtcttgaactcctgagctcaagcaattcacccctgcccttggccttccaaagtgctgggattacaggcgtgagccacagcacagacctgccctcttatttttaatataaccacagtatcgttgtctcctccccaacccaaatcagcattgatgtcttaatatcatcagatggccagttatatgttccagttttcaatttacttttttttaacaatttgtttaaaccaggaagcaaaaaaaagcccacacaatggtaattggttgatatgacttactagtttctgttaatccataggtgttctctctctccctctattacagtaaatttgttgatgaaactggctcgtttgtcctgtagcattttccacactggattttgctgaatgcatctttgtggtgttgtcttcacgtgttcctctgtcccctgtatttcccataaagtgattgctggatatcgaggcttggtcatattcaagctgtatatgtgttgctgtatttttcctttaggaggcacataatgggtttttctcactttttgtgacattagtagctgttgttacccagtgcctagatccataaaggttgccaactattgatttccaatgttagcttttcttcttcatttattagatatagtacttctatgaagaaaaactttccttcatctacaattttggtacccagtggtagagttcatataggaaagtcagaattaatgcttgatttcattcactttattttccagtttctgagataatacatttgctttctgctcctctaacagtcaccgatcagtggtggtgatagtagtggtggtggtagtggtggtggtattggtggtggggggggtgggggggtggtggtggtggtggtattggtggtggtgatggtggtggtggtagtggtagtagtggtggcggtggtggtggtggtggtggtggtggtggtggtggtattggtggtggtggtgatggtggtgatggtggtggtggtggaggtggtggtggtggtgatggtggtggtggtggtgatggtggtggtggtggaggtggtggtggtggtggtggtggtggtggtggtggtgatggtgatggtggtggtggtggtggtggtggtggtggtgatggtgatggtggtggtggtggaggtggtggtggtggtggaggtggtggtggtggtggtggtggtggtggtggtgatggtggtggtggtggaggtggtggtggtggtggtggtggtggtggtggtgatggtgatggtggtggtggtggtggtggtggtggtggtgggtagtggtgtagttttggtgccattatggattgaagtttatttgctgtgttcctgtctgttatattaggtggaagttactctagttggctcctgggtccttttgacgtgacctcaggagcctttagtacttgttctctggcataacaagttgttccaggatccttgtatacatttcttacctatagccctttctctcaggaggccctccttcctttttcatctgaagggaggagatcacaatatgggtgttaggagtgcttgttgccacagggtaggggattgtcttgccttttcattatatgattatgttgtgggaaatactgtttctttcatgcacaggccatttggctatgctgacactcttggaaactggagttttggttctgggaaatacgtggctgactctgagctgctggtctctgtagggatcttctattttataaccttattgacagcgtcaactctgcctcacagtgggacgtgtcctcgagctttagaagatctgatagagcatctcttttggatgttttttcgttgtctctgaaccacgttcataacttctcaccctaaacagacaactgctcagcccccttggcagccttttgtccatgttgagaaggagcttgacttggaatgcctttcattcataacctcctcagtatcacatttctttctgttaatttagccagtgttctgcatcttatcttgtgtttctcaccattttctcagttattttgaacgtctgctgaaggcacgagggcctcatctgcagcctctttcctagaaagccatctgatacctgtcagcgcctgctaacttgagcaggtccattgggaaacatgtttctatttcttgtcagttacactaatgaccattccctggagagcagagagctcttcctactagaactctgcctctcagcttcagagtcattgcctgggagctgtgtggggcaaaagtgaaagccctaagccagggccgggccaaccgcatttgaatctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacgggttagttgcatgcgtgaatgtagctataactaactacagtgcaacagacacaaagcaaaatgtgatcagcagtatgagttttctggttacacaagatttttccagcatataggctatactgttgtggattactatctcatttttggatttaagtatttacagacctaagactaaagagagagagagagaaagcattcgatgcccaaacacagattgtcattgacatggaatttcagaaacctgctgccaagatcccggccgagatctgtagcccatctccaaggtagcagcaccctgcgctgccatgtgctaagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggacactgaccctttgccacagactggggttgtggagaggagctttaggaggaactggggctattttgcaaatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacgcaaccacgaagccaagccctccaggagtgcatgtggatcacccagagcgggtgggggttctttggcatgctcagagccatgagcctagagaatttccatggaccattgaatacccatctcaggcatgttttagcaactgtcatttatggactattttatataacatggtcttttgctgataaactaatgttacgtgaaagtttatcacaaccagtcagctaagtgttggcaaaatgccagctccctcaggcttattaaatacagaagcttcatagtgataattctcatatttaacatgcatgtcgagaatcttatagagcactttatgattggacaggatggagttttgattgaattaagattgtacttttttaaagaacagaaataggaagaaaataacttcctatttattaagcccaactgcagatccttagcctgcctgttctagtttcagctcattgaacctagggtaaaaatctgaatgtgaagatgaaagagagaagcccagaaaggactaggtgcaactggtcatgcaattgtgtttctcttctttgatcttatccatgtcattgtttgaaaggtggggctttttctgcttttactagaatgaatcagaatctggcacttactccgtcacttgcagtattagatcccccatctgcctgggtctgagccctgtgctgatgcaacccctgccacccagccaaccctttcccctgtcatgtggcattccccctccctgggttgatccccatgcagatgcagcagtcttgtctccaagcccaaaattacaatcagtgtgccaggagagaggctacaccatagctgcacggctgttcctacacctgcagaccatcttcgctgccaccccctccctccccaccccagatctcacttgtcagcttacaggtactttgcaagcatgcaaggatttctgtctgtgccactcacctggctgtgttgctgtacacaaattactaagcctcagtttcctcatctgcagagcaagtctaattgaaccctctgctgaggcgctgttgggcttgactgaagcccccagcctccagcctggtgaagagtgagcaatcagtagaaaacagccgtaaggttgtccttctgccctgagcacctggactcttgctcccgtggctttatgagttctccagctgattttcattttgggccaaatcctagcttatttcagtggagtaagtttaggaatctcagtctccgagagagctggggaatgaggcttagagagtttttggaggagaggagaacaattagggaaagaaaaagggctctgtgggacccaagaaacaggctgtgctaggtttcttctggcctctggttagcatattgacaaacgctggttggttttgatttcttaggcaattgtttttatatatttatggatgaatgtaggtaaaagagctaggatttgaacccaggtttttctgcctcgaaggccacattctaatcctcacactctgccgtcttgccgggcagtcgtcgcggtcaacgggagagtcattttgaggtttttcgtggtggttatgtcgggggccaggggctgggaggcacctcctctgaggaagggaacgtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttcaactcctgcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctatctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataaaaaaattagctgggcatagtagcgcacatctgtagtcccagctactcgggagaccatggcaggagtcgaggaggtcaaggctgtagtaagctgggattgtactactgcacttcagcctgggtgacacagcgagaccccatcccaagaaacaaaacaaaactaatggttccattatgaaagacacctcattatgttttgagttcacaaatgatcaggtagttcttttttttgagatggcgtgtcgctctgtcgcccaggctagagtgcagtggcgcaatctcggctcactgcaacctctgcctcccgagttcaagtgattctccagccttaccctcccgagtagctggggctacaggtgtgtgccactgcctccagctaatttttgtatttttagtagagacagggtttcaccatgttggccaggctggtctcaaactcctgatctcaggtgatctgcccacctcagccttccaaagtgctgggattagaagcgtgagccactgcacctggcctgatggggtagttccttgagaccttttgcataagagtggacagccaatcccctgccgtgtcatgtgacagattttcagctgttctttaccctaaagctggtcggaggggcagtgcccctggagtcagattgcctgggtttcagccagtttcaggaaacctgtgtgaccttggatgagttagtttattgtacacgcctcactgtcctctcttgaaaaatggggataattatatctacttcacgaggttgttacgaagatacgaaaattaaataagttaacacaggaagagtttagaattggacctagcacatagtaggctctcaaacatattggccaggccgggcacggtggctcacgcctgtaatcccagcacttcggggaggccaaggcgggtggatcacctgaggtcaggagatcgagaccatcctggccaacatggtaaaaccccgtctctactaaaaatacaaaaattagccaggcgcagtggcatgtgcctgtaatcccagctacttgggaggctgaggcaggagaatcacttgaactcaggaggtggaggttgcagtgagctgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattgagtgcagagacggttggtttctggcgtggtcacctggccttctcaagcctcatcagcagccgatgacagcctgtctccggcttcagcagtccttttgtttttctcagcaaaaaatatgtatttgccccattccttcagaattcttgatttggacaggctgccttggtcttacatcgcccctattttgtcctggcctaggccaacacttcctaaaataccattccctgaggcgccaggccaccctgggtcctgcaggattcctgcctggcagaaggaaaatcacaggaaagaaggaggggagaaacaacccttacctgatgctttacgcgcctgtgagcgcaaggccctgtacaaatattgtccaagtggagcctcccgactgctatgaaaatgcgccgcttgctgtgttttgtggatggaggacctgcagccccctagctggagcagagagacccctgctaccctgcattctattctgggccctgcatggctccaggtttccagtccttctttttgcttgctggctcaggaaagtctgaccttttcccggactcacctcctggccgtgtttcctgtcctgggcatcgtgagtccccctccctgcatagcgtgcacagcatggttgcttccagccaccagggctgctgctgccttttgttgcaaagggctccttcccatgtgtttccacacaagcatcgcagcctgggtccttaggccctcccagaaccagaaacccaggggaagaacataccaagatacccctgggaagagaggcaggaagggctgtccaggcagagagcagtgagtgcagaggcctgagtgaacccgtgtgttcagtgaggagcaacgtggctagaaggctgtcctggtgggctttctgggcccttccaaggaattgagtcttcatccttcagtgattgggacagggaggggcttataagatttcataaaattgtatgaaaagaatttgtagggggcagtggctcactcctgtaatcccagcactttgggaggccaaggcaggcagatcacttgagctcaggagtttgagaccaacctggtcaacacagcgagaccccaactctacaaaaaaatgtttttaaattggccaagtgtcatggcacacgcctgtagtcccagatacttccctaggatcacttgagcccaggaggttgaggctgcagtaagctgtgatcataccactgcactccagcctgggtgacaaagcaaaaccctgtctcaaaagaaaaaaaaaaagagttcataaaaatttataaatcgctggacgcagtggctcacaccttaatcccagcactttgggaggccgaggcgggcggatcacgaggtcacgagatcgagaccatcctggctaacacgttgaaacctcgtctctaccgaaaatacaaaaaattagccaagcgtggtggcacgcacctgtggtcccagctactcgggaggctgaggcaggagaatggcgtgaacccgggaggcagagcttgccgtgagtcgagatcgcaccactgcactccggcctggcgacagagcgagactccgtctcaaaaaaaaaaaaaaaaaaaaaaaattataaacctttaccaggttttatcatctggccagatgtgtgtttttcaaaagatagctttggaagtggcaaaggattcattgaaaagcagatttttctcttggaaataattcattaatctggtgattttgtctaaatctgtggtggcagctaccgttatcctttgtaacgaacaaaatgtgtattgttaacatctgaaatgtaatttgtcatctttttatagatgggaatttcttagccataggctcacatgacaactgcatctatatatatggcgttagtgacaacgggaggaagtacacgcgagtgggcaagtgctcggtaagcgctgacagtggacctgtcgcttctcatgcactgcgtatagtttaactaccgtggaacagtgttggcagggacttctaaggccaatgaaatgaagacagtgttttaccctcccagggtcattccagcttcattactcacctggactggtctgtaaactcacagttcctcgtgtcaaattccggagactacgaaatcctctactgtgagtaccaccccggggttgtatgaagtctcgatctcagaaagcgttcactctgagatccagggggcctctgtgagaacccacctcctgtatgacttaggcacgtgccatcatctctaggtcatggtttccgcctctgtaacgtaggggagtggggctgcgtggcttcttgggtccttcccggtttcctgctgactgtgagcccctatggaggagaagatccagggcctgccccaaggggaagaaggccaagccctgcagaggggggcttggggcaggcggatgtggcagaagggggcgggtccgggtggatgtggccgaagtgggtgggtccggagctgtccaggcaggaggagggcctgtaaaggtgttatcctcacaggagggaccatgaagtccatccccgctgggtggacggcagccctgggacccctcctcctcccctcccaacctgaccctggccagtctctgggcccaggcagtgcttgggaacagcgaggatgatcgtggcgggcacttacaagcacatcctcatgccacgcactggttccttagacacccaccaggcacctgccacgtgccccactctgggccacgcagggcggcgcgtgggcacaaggaaggcctcgctgctcccctgctggaagttactggaaagcgcagcgctcctcctctgcgtcttctcagatgacctacagcactttctggcttggccgcatgatgcagggaagggctcagagcccaaaacacaggccccaagagcccacgggggtgggcgggtcacactcacttgagcgtccccacttgttgaggaccaggacaggcaggaccactggcggcagggaaagcagggcagtgtgtaccgagactgagctcgctccagtgcggagggcggccgcaccgtctcacctcctccctgtccagctcctgcctgacacaggcacaggaacggtatgattttcagggacaagccctgggtctagagccttctcagatgtggtctcgtactctgctggtgagagctcatttggggaacacacaagtcccctgggaggcccttggtttgactggtttcaataacctccattcctgacactgatctgaagggactgaggggtatagggaggcgagggggcctgaccgcagaggcagagctgtgttcaggggctcgggtgggggtgggcagcaggcggagacccaggaaccagaggctagagaagccagactgtgggaaacagacttggacggagatgggaaaaaaacaaagaagagggcacctccacccaggcccatgggctcgggctcagttccaggggaactcacatctgtgcacacgtggttcctgcccgactgggaagtggaaggtctccctctccaggaagggctctgtacccaacggggcacagctctgggggctcagccttgcttaggggaggggtggggccttggcttagatgttgccagactgtttgctttttgcaggggttccctctgcctgtaagcaagtcgtaagtgtggaaactacaagagacattgaatgggctacctatacctgcactttgggattccatgtttttggtaagtttgctgcagatttcactggttccaacaaaagagtgtctccttttaaaatatttcttcagttgctacggagtctcatggtcaccagtcttgtcagattgctcggctgctacgggaggcccatgagacacacctcctgccgcaccctggggtagggcctgggcttgcctggccgtggcccactgagaagaaccagagagatgggtttttaacccttctccactgtacagggcagcaggtcctaagataattccctggaaccctctcctatcaggttgtgccacatggacctaggtggaccagatggcactcagtcaacttaccatttgtgagggttattatttatatattttttgttcttaaactaaaaatttcactttcttcaacattcactttaggaatattttcataagtgaactaaattaaagggctgcaaattaatagaatttttaaagatagtgtttattgtctctttacgtaagactacaagtcttgtgagaatttgcagttttgtggtgttcagtgctgaggtccggaggttcactccagagctcccagtcgaaaacccaacgtgcatccagccctctcctagccacaggtattgttgaaagggtttccccgacaatggtcagaagagggcgtcccccacccacccattctccaggcccacctgggctcacccgacaatggtcagaagagggtgtcccccacccacccattctccaggcccacctgggctcagggatgcagagcctggagccagtaatgatgggcacagctgccaggctgccccaagcaagcaacagccacagtgagtgaccccaagaaacatgcgcacacccagggttaaaaggcctttggagagacccacccatgtagagttacagcaataacaaggaaactgcaggcttgaggacagggcagcttcccacaagatgcttcagagatcaaggagaggtgtcactttggaactggggttcctggtactgtctgccttggcctcaagatgaggcctcaaaagacctggcagcccggaaagcttgtctttgctccccttgcacagcagagcatcagagggtctccgagactggcctgagtgagaggagactgggcgcacagcgagaggccaggaactgaggctattgtgcttttttgacccttgtttctaaagctggacttcaggcagtttcatgttcaggaccgttcagtgggcgcttcctgcgccatgtggccctgtggcccctggtgtttccagcgccctgtttgtggtctttgttttaggagtgtggccagaaggctcggacggaaccgacatcaatgccgtctgtcgggcccatgagaagaaactcctgtcaacaggcgacgactttggcaaagtgcacctcttctcatacccctgctcgcagttcagggtaaaggacttgtttcttcactaatcttatcccccatggggcatgcacgtacacccgacctgtttggagactaagtggaaatgggctgtgagcgactgctgccagccacaaaggcagatgtgactctgttctttgcgccctgagcacttccagccgcccttagggaaaccccaagccccacaggacccacaaagccgttcagagctgctcatccacctctgcagccccacaggctcacgaccccgccctcccccacggctcccttgctccggccctgctcagccgcgccagccctgagccctgggacgcccttcttcatcctccgtgatcctgaccctggagacccctcaccctcagccccgggcatctggttaggcccacctttggggcgacctcatacctggcacctctgatactgagcatatctctcggctgagggcggtcatttgctcgtgtctgtcccctaccaggccacgaggactgtgggctttgtttctgtgtcccttctgtgtcacacacagagcaggttcccaagtgagagctgccgagcggagggcgagtaaaggaattaaggcatgcagtgagaattcaagcactttcccatcccagatggttcgccttgtagtaaaggaagctttcccccgtatcattccctccaggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaa

SEQ ID NO: 362 - DNA, 148651 bp, Homo sapiens; identical to SEQ ID NO: 361

SEQ ID NO: 363 - DNA, 247008 bp, Homo sapiens
ggacggccccggcgcgcgggggggcggggggcgcgcggggtcggcttatcatggcggatcggacggcgccccgctgccagctccggctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcaggtaagggggtggccaggggcggcggggaggggttgcgtgtggaggctgggaaggtgggaagcggttgacctggggtcggatccgggagccccgtggaatagaggattctctctggagccgcatggaattactgaagggctgctgattctagggccagggcagaaacagtgtggggagtgtaggtgaggagggagagatgtcttttcgctgtatccctccggaattctggcttttaaatctccaaggagttgagtgttctgatgctttcttgctgttctttcctgctacaagtggaaggagcctgggtaactatgaaacacttcttccttccctaaccaggtgcacggtaggaccaataacctgaagtgtgggcatcatctttgggaggctcctcagtgggtttctcagtaagcaagaggattaaaaaagatctaaaagaaattttactactggtaatttggaatcttcatctcagatgctttggacctgggaaatttctgcagtgggtggggagtttgttctctaatatttcacttggcagtgttttaatgcccaaagcatatttatacactaaatggatgcttccacagcatcattgaggttattaaaggctggcagctgctggatcacaaaatcctaccagccagcccacacaatgaccaacatctgctagcggatggcccaagactgactgacaggagagctcatttggatgaatggccgttttaggggccctcccgattaaatggaaaggggttatattgtgattcttggccctatcctctcatctttggaccagacacattttcctccagcccttgtcagcttttatgtgagcaaacaaggtatgggccagatgctgttcacagggaatccttttcagccttcagcagttaaggaagattttcgtcatatgggagcctcagcccacagggaaaatgacttgctgaggatggactacaactgacagagaccatatttataccttccaaacttgtgtgtttcattgatgtagaacaactaccattacattctcagaatattgccacttttgctctaagtttgtctttcacaatgaaataaatgaagtgatgtcatgtccatgctcctaatttctcagtgcagagaatgatttcaaagatcagcttttttttcccttcctaatgatgtgcttatattccagagccttttttttttctgagacctaaagttgaaaaattgttacagaaggcaagcacttaatattcaaactacagattttaaaaaatcttgactttttttgaagatgggagtgctaatgttctcaagatttagtggaactagcatgtaaaacttttttcatgtcacgtatgacacaaatagctttttttcttccctccctaacatggtagttgttgtgcttggggcatccttacatagttttgttctgcagattttgcttctctaattgctaggctgattatgaaagttacaggtgcaaatgattaacaatgactcatgaaaaggttagatgtttaaaaatttaaacccattatgtttttgctctctctgtcttaatgcagtgctttccattacagcatcaaaataagatgtagtcctttgggtgaagggagagagtggcaattaaacagaaaattctctgtggttaaataatattaatgtgacagttcactgaactactttgtggatttgaactcctaatcctaattttttctctgatacaaggaaaaaaaccaaatgcactgttgaagctgaaggtgggaaaagggtggagttgcagtaaaccgttgttatgacaagcagccgggctagtgggatgtgatgaaatctagcttgggtggttaaggaaacattcagatttgaagaaaaggtgaatgaagtgatgtgtataactgggtttgcagggagccttaactgatgaagggaaaaagagacagttagcatctgatctattcattaagctactttagtgacatagtagtaagcctgatttcagaggaaggactgtattcataattctccacaatatttggttgggtcagagtatgtataggtgagcagagcagagcagagttccttaacatccaaatatgtctttgtacacaagaataaaattaagttcaatgaattaagaaacacaaaccacagattattatggaattaagagctatgaaattggaatgtttatgctgttcttttgctttgtcttacatatgtaaatatctttttctggtgaagacactgcacaaaccacaatgcacaattttttgtccttatgaattttaattcgtttctgtgtatcccggttactactattcttccacctgaaatattgaagtttgttattaaatggagaggactatagctaaggttctaatgcaaaagtgttttggttttttattgaatcattacatgaatatcaaaacttgttcgtttctaattcttgtttccatcaggtgagatagcataagtaattgtccacttggtacatagcttttgcattagtttgaaagatatattcatatgcatacatctatactgctttattttttgtgctgttttgccaagaatattaactagaaagcagcccaacaagtattgataacacactccattttataaaaccatgtgatctccaagatcataatgaaccctaataataatgtaggttttggcagagctcattagggctcagcatatgtgtccttctgctttgacaggctatatgtctaagtcagatttttaaagatgttgctatgtgaggcataatataatttactgaatgtggaggcttagttttattctcttgaatattactttttaattcagataacagattagaagatgatgccatattttagacctgataacattgtgatagaacaagtgaatacttaaagtaatatttgctattgggctaacaacaagatgcaaatcagggcttgataccaaggacagtaatagagactgggataattactaacttggtttctactttaggtagtagaacatgacacagagaatgggagtaaatgaaagaaaagcctgtgaacacattcatcctctgttacttcccttccattttcacagtgattccagttgagacatttatctcctcactctggaccactatatgtattgcttctggctagttccctgtctccaggttcttctgcctcgttttccggctcccatttgcaaaggaggtttatgtacaatgctgctttaggggaaagggcactgacttcgttatcatgcacacttgggtataaatcccactctgccatttaccgggggtatctgggtgagtggcatcacttttcagggccttgtttatttgtgaaatgggaatgacaatacctaaactgcagagttgtaactattagaaaaaaatgtatgcaaagggtttagtgtggggcctggcccttagttggtgctcaataaatattcttagttgtggtagaagtagtatttcactaaacacacacacacccccagaacaaaacaatgattcatcattgctcacaggcagaagtccagattcctaagctttctgttctctctcctaacctaccatcctatccttattttccttttttaaaaaatcataaattctttgcttcccacttgccatatgatgactctgttcttccctgcctcacagtggaatgattcatcttccccgctggcccttctctgtctgtccagccgcacccctccaatggcatagcagtgggagcttggactttgctgtcagtcatacttgagtttgaacctaggactgccaccagctggcgactttaataaacctcttcgaatcttaactatctcatcagtgaaacaacttttcacttataaaatggagttttaaagtatctcctttgtagtttgttgtggggattacatacaaaaatgtttggccagtggtaagtgtgcagcaccagggtcctgtttgcatctgcatcctgcaaagccctatctgctgcagtctcacctctcccatgagaccttgtaccatcctcagatgaaggggcaccttgcacttccaaaactttgtgtgttttgtgaccgatgctgctcacttaatatgtatcatttagggctatcgtttcattctgttttcatttgtaagcgtatataagactcttgaggctgagagtgaattttataaccagagctaacatttcctgagtgccaaactcagaactaaatgtgtatatcgattgatctgatccaccctctcacagtccagtgagataggcactgttgctaaccccaggctacaggggaggcagctgaggcacagagaggttgaggatcttgcctgttgtcactgtctggcagactgtggaatgggaattggaacccagattggtctgattccaaagctgcaagctttggcttcactgctttatggcctcttatattgtggtccctacaactgtgccttcttcctaaccagaaggtagtagattgttgctctttgtaacttgcttatcctctgttggtctataaaccgtttgatttattcaagaatatttgaagtagatcattagaattctgcctggaaatgggaccatgtttaagtttgctttagaaacatccccagctcggccaggctaatcccagcaatttgggaggctgaggtgggcagatcacttgagcttgggggttcaggactagcctgggtggcatggcaaaaccccatctctacagaaaatacaagggctggctgggcatggtggcaggtgcctgtggtccctgatattccgggacctagggccagagaatctctttggcccaggaggcagaggttgcagtaagcccagtttgtgctgttgcactccagcctgggcgacaagagtgaggccctgtctcaagaaaaaaaaaagaaaagaaaaaatttaaaaaagagaaatatccacagctttggaacaatgacctgaaacaatgatctattagagattttaattaaaaaaaattattttagtcaaaattgtgacatggctcaaataatctagtgctgcaaatacaattgaacttgttggatttgaagagacaggtctaacagccatgattgggcctggagtgtcaggtaagcaagttcacatgaaggcctagagatgtgactttatattctttagtcccttgaccagtttgaataagagaaatatggaggtaactacaaagaatcaaatccatattaagttgagtgcttgctctgtaccagacacttcatgtatatgtcatcctattgaattctcccaccctcaacactgagaaataggtcttctcattttacactgagaaatggctctgcgaggggaagagatttaatcagagttactcaatggtaccatcctactgctcattggatcccacttactctgtgcattggaaagagcgcaaagtgaaagcttttgacggaagcttataatgatcttcataaatgattgcattattgctcttcttattaataaattatagtcttgtgatttttattaagatttgtttattctctaagttgggtgtaatttattctttcatatttgttaattcatcaaaaactcattttacatctataatgtgccagatgcagggggtatagcagtgaacatgacaaagtttctgccgcctcgaagcttactttctgatgggggacgccaacagtgaatggacaagaaaataagatgactatagattgtgataagtgctaagaagaaaaataatcacagagaaactgggttgaatgggggtatggaagccaccttaggcaagatttccagagcagctctctagggagatggcatttaagcagaaacctgaagggtgtgaaggggaagacaggtgaagatgtagtggcagagaagaggttatgtgcaaaagtgccagggtgggaagaaacttaatgtgcctaaaattctggtacagatagccagagaaagaccaaggtcattgtaattctcatccaggtcattaatgcctcatgggttttggtaccatatgccctagatttcccaggacagtcacaaatattccattcagttattgttgtggatacttgttcttgtgacatcatgaatctaatttttaattcagaaatatgagtccaggctcactcctgtcatcccagcactttgggaggctgaggtgggaggatcgtttgagcctgggagttaaggaccagcctgggcagcatagggagaccccattgctacaaaaaattaaaaaatttagccaggcatggtggcgtgtgcctatggtctcagctacttgggagcctggaaggtcaagactgcaatgtgctgtgatcacaccattgcactccagcctgggtgacagggcaagaccctgtcaaaaaaaatatatatatatatgactgtgttttgttttggaaaatgtggttgccacataatgggtcactgcttgaaaacattgcgctgaactatactatcttataaagaattgtatcagtcccaccaaccccatcaatcagtcatttggatgacactgtgataggtgaaaaactgttcacatggcagcagccctaattaggcaacactatcctgcagcctctcctatcctcaaggtgtggatctgaacacctttttgaagcactgtgaaattgttttccacaacagccacaccattttagcatcccaccagcaatgtatgagagatccaattcctccacatcgtcaagatttactactgtctgtcttttttttactattgccaggctgctgggtgtgaaatgatatctcattgtggttttaattttcatttccttcatgactaatgatattgatgatcttttcataaacttactagccatttgtatatcttctttggataaatgtctattcaaatctattacccatttttaatcagtttgtctttttattgttgagttctaagagtttttttacatattctgggtatgagtcccttatatattatttgcagacttttttcccattcagtgagttgtcctattcactgtcttggtggtacccttggaagtacaaaagtttttcattttgatgatgtccaatttattaattttttcttttttatgcttttgatgtcatatctaggcaaccatcacctaatccaaggtcatcaagatttactcctatgttttcttctaagagttttatagttttagctcttacatttaggtagatgatctgttttgagttaatttttatatatggtgtgaggtaggggtccaactttattctcttgcatgtggatatctggttgtcccaacatcgtttgttgaaaagactactttttctccatgaaattatcttagatgcccacagcctttgaattcagccagtaggggactaacttctcccatgtagaagatgctgaatgtttggggatccagaaatggaaataatcattaaagaggttaacctagaagaaatagaaaccataggctttggttgctattctgtatttgtaaagatgctgtttgagctaatgagtgacatatagatttttatatatttataaagtaaactataacttaaatagtgagtgcagtgtttagtaactgctggtttagtgaccaacaacagtctatacattggatttgtttactcccaaaggtttttgctttttaaaaatgattttataagcatcagccttgctgctggacacaggtctgttgagccagctgaggaggtgagtggtatggaaagcagggggagttgtaacagagggtgctctttgacctctactcttttatcagttcattcctttcttcccctaaagggaggtaggcatctggatgacctcaactagaatttgaaggattctgggattgtccactggtttgctgcctgccactccctttcccattaacacaaaggaggggagcagcaggccagcctacctcccggggatgaaaggagctctctctggactggtaataccttaataggctggtcagagaatttttctaaggctatggagaattattttaaggcatgagccttcatttttagtttaactgctgtttaataatgccaggaaaacatttttctgtgttacgagttgattttatggataggaataaaacaagactcacaaatgacaagatgtcttctaagtaagggatcatcagttgcaagaaactttttcaaagaagtacagttgagaagattacaaggtgacaagaaaaccttttggaactcaattacagggagtgtggctggtctcttaggcactgcacagtatcacgcagctattctttctctaattatttctcttggaagtgtccctgtgcatcacagggattcacgtctctgcttctctctggacaatacaggcttttattttctctggctgcttaactcaaggattcattttgcacatggccaccctcccaaaaatccacctcagtcccctgagtacaatccgtcttggtcctacagtaccaactgaatcaatcttttgagtcttaattccaaattcccaggaaagagaatcgaattgctctatcatgggtcagaatgtctaccaggtccaaacagctgtagcctggagggtgggacaatgtttcaaagggctgcccctttaaagaagattccccacccctaataaagggggaatagactgagagagaataaatggcaactttactacagaaggtggagtagaagagaaggaggcaaatgatttcttgatgcacagaaaaggacagtgatgagaaatactgagttgaggacaagaaaaggtaagtaaagggatactaaaagggcttacattaaaaatattggtgatatggccaggcacggtggctcacttctgtaaccctagcactttgggaggccaaggtgggtggatcacctgaggtcaggagttcaagaccagcctggccaacatggtgaaaccccatctctactaaaatacaaaaattagccgggcatgatggcgggtgcctgtaatcccagctactcaagaggctgagacgggagaatcgtttgaacccaggaaacagtggttgcagtgagctgagatcgcaccactgcactctagcctgggtggctgagtgattctccatctcaaaaaataaaaattggtgatatgatatatcatggagttttcacttctcataagagactgtgccgaaatgtctccagacagtgctaggcaatggctggtggccatagccttggaaggccagttgggcattaagtgtttgcccactggggtgccagtgctactattaagggttttttatcccctgctggtctggtgtcaggggtgatgggttagaggggcgcagatggaaatgaggctgatattggcaggcactggggaggtggcttgatggtactcacaggaggcttcctggggctggcacagtggccaaggtagtggaggtggggatgagggacagctgttatttaccaactggtaaagaaatagttccatattttaactggtagagatactggtgcatacctgctgaacatcaaccatggcaacgagtgaaaaggtttcacgagtgaaccgttggatgatttagtgagtgtagctatctaacatattttgaaaatgaattttcctaaggctagatttaaaacttgcttaaggctccttattgcctgcatgatgagagtcaaactcccacaagatgttctccacggtctattatgatcttctccctggcttctcttccagcctgatgtccctccctgtcttaacatcctccagccacatcacacaccttgcagttccctgaatctggcatcctattttgtgtttcctcatccctgtgtgtatcattttggttgcctgaaatgacccctcctttctccacttatgcagtccttcacttccttcaatatcaatgcaagtgccacctctccctgaagccttatctgacagctcaagactatcttgtcctcctttctctatgcatctgggctaccatgcacgttcctcccttctggagtcattgcatcgtgttgcatttgttgacttacccatgtttccatctggtttgaatttcatgtgtgtgtccctgtgcctagcaccttgtcatgggcatagtaagtgctttggatattattctttatatttcaaattatttggaaggagcaaggtgtggaataggggtgagatttctatagaactcattttatacatacttcgtgaagataaaaacccaaaaatattattctcagctggcattgagaggcaggattcagaatcttcttttttaagagaatatttgaatggcaataatgactgattattgctgtgttcttagacaccaaatttgatttgacttcttccttatacttctctactggcctagatggaaaatacagccattgaggacataatgtttcctactggaatatggccatggcccttacaatgaatgagacattccttttgaatgtttgtgcttaaggtattttgactgtattataagaaaaatcatgatttgcatccctttcaatgtaagaaatgtggtcttttaagcaacttttgaaaatctgttgaagtgtttataagagggaagtgaagtccagatgtctgcagagattgtaaggcagcatctgccagctctaactaaatttgtctttcctggcctagaagagttttacccaaacatacagaagtagggcttcgagggaagacccctggagaaagtgacttttgaaggctgaagagcggtttggcagggaggtggaaaaagaatggggaaggagggaaagacagggcaggaacagcttatgcagaggctcaggggcttaaaatagcagggtcccttgaagcaagaataagtagctcaatgttaccagaatgacagatgagagtgaggagggtacggtgggagatgaagctggaataagtgggctggagctagatagctaagggatttaccgctcattccacaagttatggagaccagtgagttcatttaaacaaggcaagagaaggccaatttacattttaggaagatcattgcaggagtatttcactttgtttttattaaccttttcttctgattcctttctcctcttttccttcaatgccagacttctcagaagagggagcgtggcattgtgcatggggattggggtcccatgggattgaacactgcatgggctctgtctctaaccagacatgtgactttgggcatggcagttaccttttctgggcctcggtttcctcatttataaatccctaagatccttccaaaatctcttctaagttaaagtcatgaggttcttagttgtctccatttactgcccccgttttctttatctctcattcacttttcaacatagtgaactggtttctacttccgccagccactggagttctctggagcgacttcagtgacctccattgctaggtggagccacatcgtgcttaacctcttcacagcactgggtcagctgatcaccttctcctcagtgcctatccttttctttcctcatcattgtggtcccctggttttctcttacctcccctgccctttgcctcctctccctaggcctacctgatacatacaggggccggtcagtgtcactgatgacattttcttgccaaaaatgcatggcgtcaatctaataatgaggaaacagaccaatgcaaattgagggacattctacaatacaactggtctggacttggcaaaaaatgttattcttgtaaaagactaaaacagattgagggaatgtccaggttaaaggagactagaattatagaactaaatgcaatgtgtgactttggattgggtggagaggggttgctatatataacagtattgggacaattggtgaaatttgaatgtgggactatatatgaggtaacagctttgtgtcactgttaaatattctgaatttgattgtagcaatgcaggtatataagagaatgtacttatcttagaagatgtgtgctgaaatacttaggagtgaagaatcatgatggctgcagtttactctcaaatggttcagtaacgatgacagcagcagcgacaacaataataatgcatatgttttctttttgtttttgtttttttaagatggagtctcactctgttacccaggttggagtgcagtggcgcgatctcggctcactgcaacctctgcctcccgggttcaagcgattcttctgcctcagccttctgagtagctgggattataggcatgcgccaccgtgcctggctaatttttgtatttttagtagagtcagggtttcatcattttggccaggctggtcttgaactcctgaccttaataatgcatgtgttttatgtgtgtatgcattgtcttcttcaaggcatcttttctctccttttctcttcatgccatgctcttttcctaagacctcttacccactgcctcttccctgcttccatccttgcctttcccttctattctaaacacagcagccagagttatctggttacaataagtaattgcagtctttgctgtataaggttgtgcggttgaacaggtcgtgtcaattctctgccttgaaccctcagaggaaaagccagagtccttgttatggcttctgagtccctacttggggatttggccccttttacctctgcgatccagtctgttttccctacattccttgatccactccagccacactggccttctagctgctgcttgaatacccaggtgctcttctgccgcagggcctttgtactcttttgcactctttctgcctggatccttgtcccctcagacattcacatgacattactcacttcccttaggtgcctgatcagtgttaccttaactgattactctatttaaaattcaaactcttctctaacacattccttattgcacatccttgtttttttttccttagtatttcttttgatccatcttggctctttaaaatataagctgtatttgggcagggctgtttcattcactgctctgcctacagttctcataatggagcctggcatgtagaaggtgcttaagaagtgtttgttgaatgaacaaatgaaagacttgtgcatgacttttatttgtttttggatgatacccttagaatttctgcttagaataggacttcttttttgtaccccctttgacaggctatgaagcctatagacaccatctcagaataataggcttgtttgttctgttttacacttttattgcagtgtaatacagatacagaaaagtacatatatcatagtgtacagctggatcaattctcacaaacccaacacacctgtaaccttgctcacatcaaaaaatcaataccatccataccacagacagcacctcatgcccttttccagtgacaatccccactgcaaaggtgacctccatcctcacttttaagagcatagcttagttttgcttaaggtacttttaaaaggaatggtacagtttgcattcttttatgtctagctcctttcagtcaatactatgttgatgagattcatttgtgtttctacatgcttattttcagttctgtattttttgttgtgtggaaatactggagtttatctgttctactgtttatgggcctttggatggtttgcagtttcctttggctactcgtacaagcattctagcacaagtgaacatatatgcagttccacctaggagtggtattgttaggtcacggggtgcacatatggtacttgctagatactgtcaaatggttttccaaagtggttgcatctggccagatgcggtggctcactcctgtaatcccagcactttgggaggccaaggtgggcagatcacatgagaccaggagtttgagaccaaagtggttgtgtcgatttatacttccaccatcacagaatagtgttttctcatgtataaagtaaaatatatacatatattctataggaaattcttttgaaatatggttataaaaatagttttaatatgtaggtatatgttatatgtgcttctttattaacacatacaattaaaagttttagtagttcttataattactatgatttaaaagtagggatgaatatacctgatgtttgagatatctgcaacaaatgtaatgtgatatgaaaattctgtgttttaccagtcacaaggtcgcaggtgctgctaacacttctatggtttgttgattaccttttgaatgataggaaatcttagtgtgttacaagttagtgaaaatgaaggtataatttttaatctaagttcatcaacctcctgaaatctataaaagggtacatggacccccaggttaagaaacccttaaggaaaatgacttacaacaaagatttcttgagtgcctcctgtgtgtcataccctgtgtgaggcgctggggacccagcagcacacagcacacagcacacatctcctctcaatgaacttgcagtcacgagggcaggagtccacatatgcacagccagatatggttagttacccaaagtgtgtgagagcctcaggacatactcctagcccattcatgggaggcggttggtggttagggaaggctttctggaagaaggggcatcattagatttaggctgtatacctgtcactctggctacagtgtggataatggattggaggaaacaagtctgcaagcacttgaagtaatccaggtgtgaagtaattgtggtagaatgcaaagagaactatgaatacgttctggagactcttgattcctggtgatggattggatatgggagagggcattgggagtagggtagaaagaaggcaggtaggtgtaacgtagtggtcaagtttctgacttagtcagctggttgaatggtgatgaccattcactgaaacagaatgaggagcagcttcagggtcaggggagatgagttcagctttgaacatatttagattgaggtgtctgtgagacatccaagaggtggttatacatttatatgggcccttgctcaggagagagctgtgagagtttcagtgtatgtgtaggagtgggtgagatacccagagaaggtagggaggaaagaaaagatcccagggtcaggactttgagaaagatcaactttttagaaaccagcagataaaggggtacttatgaaagatgggaatggtcacaggggtaggaggcaaaccagggaagtagaatgcccttgaaaccaagaacagagagagtgtcaagaagatgctcagcagactcagcagagtagaagaaggtgagtctggaaaacggcccagtggatttagcaataagaggtcattgatgaattgcttttactacataaacactgggaatgatgatttttctctggattgtactttcatctgggttttaagctttctgttatagcaatacgaatgtccaagggtcatttcctttcaggtttacttttcttcttacatctgctttatatattttcctcatgctctagtgagttttatgctgcagtggtagtaggcagtcctttcagcttaatgacttctatctctagcagactctagctctttttttttttcttgggacaataagagatattgttacagatgttgcttcttggtaaaaagacttgcaggcctatttttctgcagagtagatatgaacacattcactttgactggccctgtttgtgtatgtgaggggttggcctactgataatgactttgcaggtcatctttcttgccttgagtgaaattcagtttctagtccatatgataaaaatgtaatagaagagatataaattctataaatttataattattttcttcccagaatgtcaacaacttggatttttttataatctatgggagaaaaatgagaagctacttaagttaaacaaacgtgttcagtgcttactctgtaaatgacagtgcaggccacacgatcacagcgatccaggcaggaaccactgagtgcctggatactccttccctcctcattcttattgtccagagagccccaagtgcagctgatcttggcctctctatcttactgcttctgccctggtccacatccctggttttgtgtggatggttacaatagagtactaactggcctcctggctttgatggttactcccctagcccatcctctgctcaagaacctggtgaacttaaacaaaaaaattcagatttaatgagcccactcctaaggattctgattcagtaggtataggtgtgaggccccaaaatctgcatttaaaaagttgccatagaaatatatatataggtgtatataaataagtacacacgcacacacacacacacttccttgctctttctgttaagattactaagaaagcagtgacacatcagcaccagaaacatgactagcaccaagaattcagtttctaaagactgttctccacaaaaaagaacagaactccttggagaaaaagctgattctaggcctggggcagtgaaagcacaagatacatctggaatatcttcttgtgctagaaaatatagcagtgcttaaagaataaggggagatattaaaatgacatgagagccagcttgaagggacttccattggcgacatctgggataatttgagcatgaattataatctgtagaataaaataaaaatccttgcatccatagtgatataaataactcaatggggagaaggcaaagctcttccttgtatagaaagccaagtattaaatatagctggaatgatggagttagaaaaccaatggatgctataactagtgatgaagttttgttgagaaacgtgattttacattgtcctccaccaccagatagttaatatttacaaaggacaaacaataagtacagtggagaaacctggcaacccaccataactaaattcaaattaacattcataacaatgggacaaaccacaccattaaaagaaaaaaagattcctcaagtggttttagtctccagaatttctgctctatgctagcactggaattagtgttctgtggcacagatctgatctgtctctgccttgcttaaaaactccggccaactctattgcttctggaatgcgaccctacccccacctttttgccattatctcttgccacagctctgtttccccgactttcctacctttggtcccatcacccatactccttgcagtaagtcaaagggtatatgtgtctccatgttactgcccacagccttgctgctgaaagtgccttccaggtctctggaatctgaatttgtggcagattcatataagccaagagacaactacagtgtcaccatctctgtgaagccctccctgatttcatgggggcagaactaatgtctgtttcctccttgccactgtagcattttctccgtctcttaaacacgtctcaattctgctatgactttccatttgtgtgtctctccaccccagttatgcaggcgactggcccctctgtgtcccggaggctctttatgtggtggaaaaagctagggcttcagtgccagtcacacctaggtttgaatctgattctaccacttcttagttgttacacagccagcctcagcttcttcctctagacacactggtagattgttattgagaattcaattcagtaaagcatataaggagctttgcaaagtgagttgaagaatgacataaaagagaaagaaacctcactctaggccctgagtaagttttttcacacgtaagtcctcactgaatttcatcattgataggtctttggaaactgtgactttaaacaaaacaatgtacaacaaaccaattttaccatcagccgattgatataaagagttaaattcctacgcatatttctggccacaggaaaatcactaacctaactaaagaccaaaatgcttatcatattaaacattaaagtaaatgggagctatctagatgtttaagaaaagttaataaaaactagtaagataatgatttacttgtttattcagttcagggtcccgggtggctggagcctatccccgcagctcagggtacaaggtgggaaccagccctggacaggacgcagtcacgtcgcagggtgcacgcacatacacagttgcactcatgtagcactcatggagacacaccagttcactgaacatgcacatctttggaatgtgggaggaaagcagagcacctggagaaaaccctcgcagacgtggggagatcgtgcgaactccaaatgacagtggccctggccaggaattgatattttttctcatcaatgttgtaacaagacaatgttattcaaggacctgctgtatatatctattattttcaaagacgtattttatatatatgcatttttccctgtaatcctgaagagaattcagaggtatagttacatggctagtaaccaacagacccaactttgaacctatttctgactccaaagccatgttctttctattacatgggaactcataaaccaggagagacagagccaaaattaccttaaataagaagcccatagtgaaaaatgttaagctagagttgtagtctctaaactttttttgattgtatacctctcttggtaaaatactcttgtgcaactcccactataggaatatttgtttttttatatatttatgttatatacttgtattattgtgctaacattatattataaaacacatatgacatttacattaaatttatatgtgaatgcaatttacatataaatttcttactatactcccccaaatcatcttgcacatatctttgaaaacccctgaactagagaatagaggaaggaaggtaaatttgactagtggggttttggaagaacccattctggaagagatggcatttgggtggcctctaggaggatgttaggaagttagctggcacactgggtgggggaaagcattgcaggttgaggtcacagttaggatgaagacaatgcattggacaattctgggcatttacattgaacaatggtagttgggccagaggagagttgtggggggtggggggaatctagaaaataataatgtagcacacttagaaatgcagctgtgagacaggcggccttctgagctaaagagattgctttatgttagcagtcttttgtggggaaaggaaggacccataatggtggtagcctagaagaaaacaagagctggctgagtgcctaaggggccagaggaagggatgtaaacccatgggaatgtccttgggtggcaaagtgaccccgagggataaatttgcaggaacatgtaggtgatttcacatttggactggataaaaatccaaatgcggaggtgagccatggaagctttgaaagatgttagtgactgtgactggatctggattttagacatacggacttataaaaaagtagcatggacaggggagtggggtgtgcagagtcagggaggccagtgtgaaggaatgacctctggaacgcagagcagggggagcaggagggagacagtggagaggcaaagggggcattcatgggatgaggaagtgggagagggaggagcaaatgcattagatgactaggaagttgtgggtcagttaggggagagagggaccgaggaggaggattgggttctggggtgggaggatgggggcctatttcagacatgctgagtttgaggtgcctattgaaaatttaactatggacattagaagtgcacagaagagaccttgcctattcaggtgtcagtcaccactgtattaggtgcaactagaaggatgggaatgcatgtgtataacacaacacacacacgtacacacacacacacacacacacacacacacacacacacacacacacacacacacacaccctgccatgcaggccttcccagtgagggagtgagggaaagaaggcattgtggggtgcggagaagagggcctgcctgcctgcacactggtttgggggagtctttacaagagaagggatgctggaggcgagtctttaaggcaggaaggattctccgggtatgaggtctaggaagactgtcctgctattgactccagggtagatgagaaggaccaggtttggtgaagcagagaggtattacagaacactgaattcagtttagaagtggttaatcttgggacagactattcttttaagggtaacttcccaaggagggaacaggttggcagtcttgactgcaggtctgatcttcaggaaggtggttggatggagatccagatgggatagtgccttctatgaaaggtagccagatggataaaggtgagactcatgtcacagacactgactgagtgcctgccaggagatactgatggaggttaacatatgggtgaggtgaaatgcatgtgaaatgaaaaggcacaagaccttaagacaggccaagtctggtggtcaatatctgtaatctcagcactttggaaggctgagagggtaggatcgctcaagcccaagagttcgagatgagcctgggtaacatggcaagactccgcctctacaaaaaaataaaaataaaattagccaggtgtggtggtgcacctctgtggtcacagctgcttgggaggctgaggagagagtattgcttgagcccaggaaattgtggctgcagtgaaccatattcactccaccacactccagcctgggtgacagagcaagaccctatctcaaaaataaaaagagcttaagataaaaccatggggtacatccttccctttaactactgaggagaggagaagaagcatgaaggggcctgagcaggagcagagtagccaggaagaattggagaggtttaggattgtaaaccaagggaggagcaaaattgtaaaccaaattgtaagccaagggaggagcgaaagactctgcatgtgttttgctggagctggtggtggaggaagtggaggtggggtcaactgtggagctgtgcaaaaagatggaccaggattgagactcaaaagaggttaagggaagaacaatttcattccaatggtatggggcagaatccaaattgctagaacaatgagtaagaatgaaaatgtggaggcaatgggaaagtgtagcctaattagggcaaggcatttcctggtatctggaagatttaagagttgtcttgctaataggcacctattctgggagattcaacatgcccaagatgccatctgtttcagtagggaatactgaatgaaggtgcaggttgaccatcgactgtgtctctttttctcaaaatgatccttaatcaagaggacatatctgctttgatggagcaacaagtcagaggtttgaaaatctatttattgttttccttgggtacaggcttgtgatttcgtttgtttttatggtggttaattattcctgaaatttcaagatatatacaacattctgtttaagggctttgtcaaaaataaaaatataaagaagagagaaaaagaaaagagtgttgttgttgttactaatccttatagtatgtcacactgcgaagactgatttataggtgcaaattttacagaattcaggacttagtttttttctgagttatagcatctttttttctctttaagcgacttttttgttttatagctagaaaacgattgatctgtttataggtatttaattccatacgtgtcctagtttcatctaattctcctttgaatctcaaaagctaattcagcagctagctttttctttctgggtaccacacaaaaataaaaaatcaaatttccagcaataaatcaatggaaatgttagagcagtactgtgccacgagtgatcagtgattggccatagatgccacatcaaggaagcagtcactcagtagatatcccaggagtgttttttactgaatgtcaattactgaatgtctaacttactttctctggcactgtatgcacttcaaagagactgcagtatgagcgctgtgtattttctacagcctgtgctcattcaaatcttcatttgaccttttcccttgtgttcacaggaatcttaactataggattttaaaagtgattttattaaatatcaaggagatacataacattttggtaaatatgtaaagtgtaagtaataattaaagatttttagaacttcaccaaatgtcaccactgtgttggtgggtaaaatgctacacttgtttttctaattagaacaccctatgcagtgacctgagagtccaagggcttcatgttttcagagcgggtcacttcaccttttcagccatgacagaagcaaatctagccgaggataccctttcttttcatgccaagtgtgctttctgcataataaggtaaaaggtctgctagactgatgttcaggtggtggcaacatactactataggacaagatcctgaaattcaaaatagtgggagttaataatgggacattttgtgaaatgactaaaaacaaactcattaacttatatattctttggtaaccttacttatcactaggctaggagaaaattagtatgcatgtctgaaacccacataaagaatgaacttaattcttgcttaagactaaaatggcaataaaaagtggtaattgtaagggaaattggaactttaagtaaacttatttgaggctctttgttttattttatttgggccctaagcaaaaattactgtactaattagcatgattgatttcatcccatgttatttatccttaagatatgaaattatgaaaaaaactttgagatacatgtgaaaaaatgttaaacagttcttgtttctactagtatactcattttaatcttctttatttataactacattatacaaatttatctaggatttttactttatattaatacttggattacagaactgagtcattattacttatcctaattttgtgcttggttaaattttgttacaatttataggtttagaaactttcactttaaaatgtgcaaggtattccagtaattctggggaaaatgggttccttatagtgaagattattacaaaaattataatgggtaaaattgtttattaattctggcaagacaccaaaaagaaattatagtagttgacagaaaactcagaaaaaataaactgtaagagaacataggaaattatcaaaactatgattatatggtgtcaaagaaagactcaataaaactttatttccttttcatacgaaaagatttgccccagtacctttggtgggcataatttttatatgattcttagttgaagctataaactaaaaatcatgggtgttattaaaagctgtcttctaagatcctacctggattgggagaatatggaatctggttttggtttttcttcttcaggctaaagggccagagtatcttgtttgctgtcttcatcactggtccagcacaaggcctagtatagggaggacactcaacacatttttgttgacttgaattgactcagaggccagtgtttacatacattgtggctaccagaagaacccctggacttctttttattggggggcagggaacaggattgcactctgtagcctacactggagtgcagtggtaggatcatggctcactgcagattcaacctcctggactcaaatgatcctctcaccctagcctcctgagtagctgggactacaggtgcatgccacactctctgctaattttttatttttatttttgtagagacagggtcttgctttgttgcccaggctgggctcaaactcctggcatcaagcaatcctcccaccttggccttttaaaatgctgggattacaggtctgcgccactgtccctggccagaatccctggacttctaatttgtcagttcaatcttggttttatgtctaagccttcatatcgatggacatttagattgttgactattatgaacactgttgtagcacacatccttatgtatactttctagagtatatgcgtgtttctgtagcagatatttctagaagtagaatggccagggtcaaggaatgtgtatactttgtattgtgatagatgttgacaaattgcctttcaaaaagagatgtaccaatggacatgtaggaaaatgatattcctgacggcttcctctgctcttatatcacattagttttaactctcttaaagacagaaagaatgtggaaattttaaagttaagaaagtaaagcattcatgggtgaaaataataaacaatgtttcttcttttctgtttggtctctttcatggtaaatgcctacatttacacatgtgaagactcacagaaatagtctattaaaataataaacattatattcaaatataataatcttatattcaaatatcttgggcttgatcatttaatatgtgattgtttaattgctgtcataacataaatagggatttatcatactgtcttttctatagagttgtcctaccaataatatatattatcgatgcagagagaagataaaaccaacattttataatgtgtaccttattgattaataatatgtaattatatacttcatatatatgtgatttatattacctattattatgtactgggcacgctgagcattttgcatacattaccttatttaatgctcacaaaaaatttttgaggtagatactattattccctgtttactgaagaagaaactgaggcctggagtatttaagtaatttgccccaaaacatccagctagtagctgtcaaacaggagttaaacccaggcgtctctcaccccacaccccagctgcctaatttacgtaattgtctggcatattttagtcactcagttattgtcatctgatggtaagaatcagggatatttttcaaagaaaaataatgacatgaatttaacatgaactcccatcacggtatgtccatttgaggctttcagagaggtccctactgaaaaaactagccctcttctaagaatttctgcttgacactaggtccagatcaatttttttccttgatgtttgctgaaagcaatggcaacaattcctgtcacctgtttcttgaacaagggaagtactttggcacagagcagggccctgccacggtgagctccaggactatccatcgtgcactgtccacaatacccccttggcctggctgcccagcctgagggcccgatatttggcttttggatatggcccaggaagaactcaggtgacatgcagattgataatatttgactcctgggacgggactcaagctttagacctggaatggccaagctggaactctgccattccgatggcttcatagctacttactcaccagccagtctacagcattaggttgcttgctcctctgggaagccataaagagctggtgtgagcagttagcttattggcatcaccaccacagttttttggtgtttagagactttcagttcagggtaacagaacccaactcaaattggcctaaggaaacaaaggaatttagtggcttatgccactggaaagttctagattggtgctgacatcagagcctacagggactcagatgactgtcagtagtatcttagactctccctttctccatctcttggctgtgtttctctccggtcgttggcctcattctttccttctgctggccgatttttttgaacctatgggtataggcagtatgttgatgccaatggtcatgggtggcttctggtttccagcctctcagctcaagacctcagaggaaacagggagctttcctagcaacagattgtaaagttacagggaaggacactctggccttgcctgggtaatgtgaccattttagacatatgactgtagcccagaatgggtatcatggttgtccgatcagtgcaagaaattgtgattggcagtcctccccgagccacatgggatggggaagggccaatttttttaaaaaggggagaagagttattaccagaagaaagggaaagaaatgttgagcttactaaaacaatatgtatttcaaagtggtagttacaagaaagcctggaaaataataggatgttgagcttgacgcatcattcagagaacagatgagtccaggaaacaatagatccctgcttgttatctctttgaaagggatggttgccttcaccaatatctttttaggttgagaatcagatccatgttttatggtgacaaagacaatttacttgggcaaagggcagaatcatctgggcatgttaaatagcaaatatgaaacctgcatattggattactggtgtggaggacagggatcacttccttagtgtagttcctgagaaacacacggggatgtaaaggagcttgggcatgagcttatcttggaggactctaatgggagtatagataaaatggaagcttctgaacagaagattccctttgaatactgagcagaaggttcacaaggaactttagttattttatgcaaagcacaagggaacagagaggattaaattagagcttctgcttccagaaaaagaaaaaaaaataggataagtttaaaggaagagaagcttacaaaaggaaggacaaatgctccgcagcacacagtaataccccgtcccctcaaccttccatcccccatatccttatcaaactttagacagatttttaaaaatcactgaagttattttgtgggcctatatttaaaatttatttttcagtttagacagaacatgttattccatgttggcacacagtagcctaaaagttgtcttggttgaccgtgcaaggtttgttatgctgaatatatagtgccatttattgttaacttctggctaataaatgtcttcaatttgctttctgaaaactgaggcagttagagggtatcaaaaagaggatgaaacttttatcatccagtttcaagaaataagggtgataggcctttgggtttcataatgataactggaatcctttaagggtttgcattttgtgtatttaactattttgaaggtaaacttcagcagcctctatttgtaacttaggcttccaaaactttcttccttctttcccaccttaaggatgagtgcactttagggcatcattttcagcatgtctagcgtgccagtgtttttcattacactgtgtttaaattacatgctctacttaggtttgttgggaacctcacagaatctcagttctgctgttttttaaaagttactttttttccaccattataatacctatatttactcattaaacaaaattttaaaaataagacaagaaaggaaaaaattattcatagttgaaccccaaatatctgttcacatttttgtgaacttcttaattgaaatataacacatatataaaaaagtataaaaattatgtgtttatgatgaaatttagcaaggttaatatacccatataactactacccagatcaagaaatagaacattaatgcagcctggaacctctcacctaccacttcccagtcattatgccctcttgaagataaccactattctgactcctcttatgtagatatgttttgcctgatattgaactttataaaaattgaataataaaatatgttctcttttgtgtggggctgaattattcaacatttgtcaatgaaattcatgcatgttgtagtagatagcattcgttcattctttttcattgctgtatagtattctactgtgtgaatataatttattctgtacttgctcttagccaaaaggccaagaagtgataaatataatttattgtgttcactattggacatttgggttgttttcactttgagtctactataaataatgcttctttttaaaccttttttttgagacagagtcttactttgtcacccaggctggagtgcagtggcacgatcacggcttactgcaacctctgcctcccaggttcaagcgattctcctgcctcagcctcccaagtagctggtgccacaggcatccgccaccacacccagctaatttttggatttttagtagaggcggggtttcaccatgttggccaggctggtctcgaactccgtgagtcacggtgcccggctacattcttatacatgtcttttgacacctggatcatagggcatgcacatgtttagccttaataggtatattaccaaatggttttaccaatttatataccactaatgtatgagagttctagtttctccacattcttgccaagacttggtattgaatgtctttttcagttttaattatcctggtgtggagtaccacattgtgtttttaattttattttctctgatcatcaataacattgagcactagtgtagtcacaatgatgttcctctaaagatatatcgatgtcctgatccctggagcctgtgaatatgtgacattacatggcaaaagggactttatcaatgtaattaagttaaggatcttaaaatgaggagcttatcctggattatcccagtgggctcaatgtaatcataaaggtccttataagtgagagtgacagggagtcagagaaggagatgccatgatggaagtagtgatgctatgaggaaggctcgactgaccattgctggctttgaagatgaaagggacctgctagccaagaaatgtgggcagcctctagaaggtagaaaaagcagaggaacagagtctcccagtctccctagggcccccagtaagaatgcagtcctgagtttttttttttttttttttgagagactgggtctgattctgtggctcaaactggagtgcagtggtacagtcatagctcactgcagcctcgaactccaggcctcaagctcaagtgattctctggcctcagcctcccgagtagttgggactacaggtgcacatcaccatgtctggctaattaaaaaaatttttttggctgggcgcgatggctcacacctgtaatcccagcactttgggagaccaaggcgggtggatcacgaggtcaggagttcgagaccagcctgaccaacatggtgactccctgtctctactaaaaatagaaaaattagccgggtgtggcagcctgcacctgtagtcccagttactcgggaggctgaggcaggagaattgcttgaacccaggaggcggaggttgcagtgagtcgagatcacaccactgcattccagtctgggagacagagcgagactccgtctcaaaaaaaaaaattttttttttttttagagacagaatcttgctacgttacccaagctggcctcaaactcctggcctcaagcaatcctcctgcctcagcctcttgagttagctgcgattacaggtgggagccactgcacctgtcttgaaaatctgaccactagtcagccttgaaaatcttgattttcgttcattgagacacattttggacacctgactttcagaactgtaagttagtacatttgtgttgtttgaagccactaagttcatggtaatttcctattatggcagcaataggaaactagtacaagcaccttttcatgtgcttagtgaccattttgataccctcttttgtgaagtgcctcttcaggtctttttgaccatttgaaataactgggttgcctgtctttttcttattgatatatatgagttatttatatatactggatatgagtactttgtcaattctatatttcaaatatcttctcccattctgtggcttgcatttgtattctttgatgatcagacattctttatttagtgaagtccaatttatcaatctttatcaatcttttactttatgattagtgctgtctgggtcctgttaatgaaatatttccccaattcagggttatgtaaagattttcctatgtaatcttctcaaaacggcactgtccagtagaactttctgaagtgcagaaatgttctatgtttgtactgtccagtggtagcccactagtcacatttggctactggccacttaaaatgtggttagtgaaagctaaattttaaattttattagattttaattaattcaaaattaaatgtagttagtcacatgtagctagtggttaccacaatggataccacagttccagaaactttattgatttacctttaaaatttaggtctgtgatccaatggaaatgattttatgagatggtcatgattagcaatttgttttttaaatacagatatacagttaacccagatctattattgaaaagatcattttttaacccattgaactagtggcaaccttgtcataaatcaggcagccctaataagtctgtttctggattccattctgatccattagtcttcatccttgcactgacgccacgctgttttaattactgcagtttgaactctgagaatataacctctctgactttgtggtacttcttcagagttgtcttgagtattctgcgtcctttgtatttctgtatcagttttagaattgatctgtcaatttccattaaaaacctgctgatattttgattgagattatattgattgtataaatcactttggagagaattgacatctttataatattgagtcttccaatccatgaaaatgatatatccctctactttgttctcttagtaatggtttataattttctggaggaagtcttatccatcttttgatgttcatctctacgtatttgatgggttttgatgctattgcagatggtatactttcaatgttcattttctaattatttttgctagtatatagaaatataattttttagttttttcgagacagggtttggctctgttactcagactggagtgcagtggtgtgatctcagctcactgcaccctccacctcccaggctcaagcgatcctcccacctcagcctctgagtagctgggactacaggtgcaggcaaccacgcctggctaatttttctatttttagtagagacggagtttcatcatgttgcccagggtggttctgcttaggtttttaacctcttaaccgctgttttctgcttggctaagaaagctcttccttcttgtatgtactggttaggaatcggcaaataccttaaggggaaattgtatgcagagggttggactttcctctctgccataccatttttaatttggatcttggccctcttccttaagtttaggctgccttggaagccctgaattctaagttttgtttctctcattcagtgagaatgccgtgagcgataggtggcagtttctgcttaccctctgggctctgcactgcaaattggtaaatgccccaaggaggcagagtgggtgaaatttagggcttactttaatgttcagggcattgctcttctgtcaggatccctgcccctaaaattcctcctgctttggtttgttcatcagtgtcttcaatcgactgtgctctttaattttatctagcttttatagaagttctcaatggaaaggttggtagaataaaattcactttgtccaacacagagtggatgtctaaatgttaacattttaatggatattcattctgtttcctttaatgtgcttatgtttttatgtctgtgagcatgctgtttatacaagtttgggttttggtcctgattttatattgtcatacacagcagtttcttgaaccatttctcttgtatttgggcagtagggtgtttcttttattttcctttttaaaaaaatctttttttaagtttatattttcctttttataaatgatgttctcaggagcatttttttctacaaaaagccttttttttgatttggggttattttcttaaaaggtaggatttctaatttatttttgttgtggttttctctgatactctgggtcattattcctggcatactgaaatttaacaataatgtggctttgtttgggtcttccatccattgatcttgccttttttgggcctttcaacctacaaactcctgagtctcagttctggaatgttttcttgccttcctttccattctctttgctctttcttcttcaaagctttttggtagttttgagacctcctggatctgtaattgtaatcctattttccttattattattgttttctattttctggtagatttttctattttgtcattcaaatcggttgaatttttatttttatattttatattttaaaatgctttttaaaaatttactgaatttttcttttttataccttcttgtttcaatatattgccatattttttcttttttctgagtatattaattatgtccctcccttatgtctccttccttttctctgtcacctcagcattccctttttctcctgtatatttgtattggtctttaacttttaggttcaaggctttcatcagatgttgggcaggctttggctctctttgtatttaagagcaagacccctgaaagcaaattgggagctctatatgaggggcagtgttgatgagtggtttcaccatagggtgttaaggtggtgcaccgcctttgcaatggaggatgctgtaatacaatgtcaggatggaggggcattttctcttgtgttggtcagtttccccagaaaggaacctccaatctcttgcctgggggtgaccgtggggtatgcagtatacctggtggcaagtgttccaggagtaaaatggagagaggttttatggttcacaaggccgccgactcacttaacttcctgtatgagctttcctcagctgggcagccccagagagtaaatctccagagttctgctgggtgagaggaggattctggtggactcactgttctttacacaagctctcaactagtcctcctactttcaccccctccctccactccagccttcaggatatgtatctgcaaggccctgagcctttccaggtttccggctgtgagctggctgcttctttctgacttcccccttcttcctcccaccctcgccctggtaggcttagatttcttagggttctaaaatcagtcaccacttactcatttgctttccagctcctttttttttttttttcttcaaggtttcttttgcatactttatcctttcttcttgttctctttgtctttgtgggcctgtgtcttttaaaataactccctatcttttcaatttggcaagaagcatagataaatgctttaaaactgaaagtcttgcattggattttgaatgccagtcaccgtaattttcatttctatgagttttatttgactttcacttttcttctgttctcgtatgcattattcttaccatgtgatatctacaccttcatctttttattgattttaaatagatttaaaatctttccagctgttctattgttttcaagtcctgaagggagaggggagtgggtggaaagaagggatgctaattgtcttgcttgctgtgtctcctgagtcttccttacagtgacttgttttctttgtccagtgtaatactatttctggtgggagtcctgtatgtcctggttgtggagacatccctacagagtaggttttgccttgcttctgatggcccagaatgtgctcttatagtttctcttatttctggacctctatacgtgtggtttcagaaatgttctattttctcatctttgcttcactgtctcttactaatctctcagatctctgtttagaagtgattttctctgggacggttttcccagtcccccattccctgtattgtcccctagtatattatacttcctccaacgtagtacttattaccctgtagtatatcatccatttgtttgtctctctcttccttgtgactgattctggaagacaggatcatgttatcttgttcactgttaaatatctagtgcctaccaaagtacctggcccaaaccaggtgtcagtaaatattttataaaagaatatgatgctatatcttgttttaagaggctttgcagggatgggttacagattggtctgagagcattgtttttttaatcccagttttgctacattccaggtgacactccttcatagagcaatgtagggtaatgcaggggtgctctgcaaacataaaatatgggtggttcataagttgcctttttgagctatagattttcttcctgttttcatcacttccacatatagtacataatggatcacacacttgaaaacaaaaaatagggatggagtgcttggcactcagcacacgacccagtattcttgtgtggctccctcttagacccagtgaagcagcctccattaggtggatgttttcaattccattttccatttgtgaaatgtgtgattatgaaacagctgtgtaacagtctgttgtgtctagcatgtcttcttttcaggtagtaggaaatgacaagttcatactagatgaataataatatgcatatctgataattaggcccacagtttacagtggctttgactggtatttcatgtagctatcttcaaaacttgagtttaggaatactgtccaaagaattttttttatagctaattgaatgagtaaccttggttttctggagtattttatggtaatactagaaagaatagtggtggtaactattataagatcatgggggaagtgctaaaatgagtcacttattttggaaatagcaataatattatttgctaatatttattgaatgctgactaaacgcatagtaactttattcatttaaggagcttttaaaggttttatagagtttttaaaagtcataaattcagacataaattagcaatggatgccaaatctgggggagagagaaaaactttaaaaactctaaaaactttacatgtaccaactcatttaaatctaaagaaaagttggatttataccaacacatcttcatcaccaagctagcatgtgaatgctcaggagagagcatgcagaatctgctcaaaatggagacattttaactatatcccaatgttaggctgtgctaaggtgatccaagagtgaagttcgaggttggacaaaattagatgtaattaatagttgaggaaacttccttccctccatatatatatatataaaatctttgtttacatataatatatatttatatatattttaatgattaagtgtaggtgagaaataagataacttgctctagatatcagcaggatcattatacacagcaggatcaagactccggctccgattctgggccattactctgatgcattaagaatgttagtaatttaaatagcctaacttccagtttttctcagtttccactattttgtagtcaaattgatcttggtcttagatttatttagtgtttgactcgatccatatttttaatcattgaaaattaatttttaactacttaagtaatacatgaataagttttctttttttttttttaattttagaacattccaaatgaagctttcatttcctgtcctggtctccctccatgctccccagatattcactactgctatgagtttggtatatatttttcagatctttatattcacgtactacccaagaacataacagagtattgctttatgcatgtgcttgatttctttacataaattcccctattgacagacttctaggttcttttgcttttcaaacagtgtttcagtgaatccttgcacacatgggagagtggccctctagggagatatctagaggtggacttggttagtcacaggtatgcccattttcagtttcaatatagcctagaattgcagtacctagaggcagcaggcttgcagagtacctgtttccctaccatctggccggtatatgacactatcaaattcaatttgttttgccaaatgtaattttatctgggttttctttcttatatgaagaagtaagtttctatctttcccttatacaaacaaaccttgacagagaatcactgcttttgtcctggaattcggaagatttcaaagatgggaggtgtacatgagatccattctctctccccattgctttgaagttgagggagcatttttttttttttttttttttttactagaaaaagaatctgggacagactgaaagatggaagttactctgtgtctgggaaatacaaacctcctgaatctagaagcatgaggcttagtatgatgaatggtgaccaataatgtttttattaatctgggaagtactgagtttggtaatcagtatctttgaggtttatgctagtgaagttaatcccaaggcatttgagaaactagatttcagcttctctgctttatggttttaattccactttattcttagtggtagtgcagccaaatgataataactctcatcattgttgagaaattgttttccatatggttatttcatctgagaatatgattttaaacagactaccaaagtcatagtactcccagtttgtggaacggacttgtttaatgttataaacttgaattttgcagttttgtgaaccaaaaaatatgataataaacaatacgctttgtttcttttttattaatgcttaactgaaaaaaaagcataaatgaaggtgcttatttttattaattggggaaataccagggattaaacaaagcttagtccttcagtgtttataatttctggtaagaaagttgaataaggtatttccccttttcagagcagcttactagttttatctgaggtatataatatgtgaatgtaattaaattatcaaatttggttgatcatttaaaaaatcacaaaggcataaaagtggacatttatgaatcacattgcaatttggtcaaaagtgattctttcactaacataaatcataaactctgtggatatagcttgactttaatttgtctgaattatgatatggaaatgtttaaaatggtcaaaaatagttgaggtacctatgctttaagtttaaaatataagtctatttaaacttattttggaatcatttcaaacttgtagaaaaatagcaagaatagtccacagatttcatccatttttagtattttgacacattttctttgttattctttctctttatagatacgcattagtattgcttttttttttggaatcacttgaaagtaggttgaatgcatcattcccttttacccttaatactaaaacatgtaattttaagaataaggatagtcacttgtataaccacagtatggttattaaattcaggaaatttaatgttgacacaatactgttatctgctctatattcttctttagtcagtaatgccaataattgcctttagggcaatttttttctggtataagatccagctcagataatgtattgcatttcattttcatgtctccttagtctcttttaatctggaaaagtgcctaagcctctctttatcttttaggacattgacattttagaagaacacaggccagttcttttactgaatgtccctcaagttgggtttatctgatgtttcctcatgatcagctttagggtatgcatgtttggctggagtacctcagaagtgatagtgtgtcctcctcagaacatcacggatgggaatgcatgatgtctatccactcattattggtgatgttcaatctgatcatggtaaaatcgatcattaaatgttatccattttctctatcatatagttactatttttttcttttctaattatagagtaatttgagtggaagtgctttttaagactccacataaatatcttactccccaagcgtctcccacctccagatttagtatccgttgctaatttatgtctgaatttgtgacttttaaaaactccattgttccttccatatttattagttgacattctgctataataaagtgcttcctgcccttatttattttgatgctcagattatccccagggccaataggaactccatttatctatttcctttgtccttctgacatgctttataaatttgtgtagcatcttattgctgtttggcatcatagctgttccaggtccattttgtactttcccttccctagcactggaatcaatttctccaagaaattctggttcttttagtgggactggtatttaagaactgtgatctgtgatcattgctgtgccagaatgtcattgttcttgaccttttcagcagatggagctggggaatatatatacctacacactcatatatatagctaaaaagatagagatacatttaaacatcttaagtttatactggtaaccccccaattccaacacagcttcccaccctacattcttccttggtttctcccatttattatttatgtctcttttcttccatagtgagaagtctggctcacaaaacataatacatttattcatttgatccatcctgcaatgtgcataaaatagtttcaggattgtatacccatcgagtatgaaaaacaaactgctaagaagagttcaagatttatttgcagttcttttatatttctttacactgagcatgaatagtcaaagttctatgttcagaagttacttggattagttctgtattttaaaaattcagcatggttatgttattcattttaaataaagttgggttcactggaatacagttaggtttacattcagttttaggcttctccctctattcttgttgatctaattgaatttttgaatgtttatagaactttaacatgattccaaaactccagactatacaaaataagatatactcagagaagtattccaagcttctttcattttattatcttttaagttagcaatctgcttttaaagaatattgagaatttaaaatcaaacacagtgtttggctaggtgcatttgtgtggtttttggatgggtaggtgggtagagatattactgtctgttctccaagtcatagaaaatatggagaatgaaaatcgtctttctccttctaccaggagcctaaaagggtgaatgtattcaaagtggttaaggtaaaaattgggtatgacattaatttcatcggaaaacagcttcagcaggcctggcagggtagggtgagggtttggaaaggctctggtgctttcagggcgtgacactagggggcaccttggctctgatgctgccttcaggctcccttctctgccagagcgaggctgggaagtgaggttcaagatctccagccctgaaggcctctccaaactccgttggttgttctgtgccatcttgtagggttttgacccaggggtggacagaagttgaaggacagggacattctcaggcctctggccttttccctcgttgaccttcttaacttcctgccctctagtcagcattttattttgtttaggttggcaaaagtggctgagttaagtaacctgtccaaggtcatcattcaacctccaagcagtccagttattttcaatatgccattttagaaaggttatagacagcggccatttatgctgtgtgcctgtctgcctgtaaaataagattaagtccatataatttcctaatacaaaacaaactggcacaaagtagacatagtgggaatattattagttacacgttatgaagttggaaaattcaaatgagagccatttaaagtaaatatagaattagcgagattagaccaagaggaaaaaagttgagctgataattaactcaacatctgatccccccaaagcaatcacaaataaattcattatccctattgctcgtgaaacctgggggcactccacttgtataaggaatttgaggtgcattaactttaaattgcacttgtctgcttcttgttgcttgtgtaggcatgtttgcattgcttacattaatgcttagtaattcagtggctaatgtgaaatccccctgctttaactttggggaagataaaattaaattgtgccttcatcaataaatacaagaataggttaaaggctgaacttgtttttaagaacatcacctatctcatcaggagtgactggttaaatactgttctgcctagggcagaatcaaacgcagtttggggaaatggggcagcaaaaggccatggtggccttttcagctttctttctatttggtatatgcatggtaggagatgccagattcctatttaacctcttctatttacaaaactgcttatgccaaaatttattcatgagtgcttccattaaagcttgtagtgaattttttccacctgggattgttggcatttgattagtgggagatggttaaatcacacatatgaatagttagctaatatttttgctttcagtgtttgtttccatttttaaaatttttcctctcttttgcctacattagaatttttttttctttatttcccactttctcgtaataatatattttctggatatcttcctttgagtggaaaactacctgaattttaaatttaagtgatcgtagaagttttagaagcagtaaatatttattatattcagcctctaacttattgtgtataatttaacacacataagcagatctctagaaattacttacaagggtatttttaagaagagaaatgctgatcttatatttttagtatggattgacataattttaaatcttcttaaacaatggctaaaacttgttatgaattatctatatctataattttagcatttaattatatatctcctcttttgaactgttctctggttgtttaccctcttttccctacaaacttaagggcaaacaaattttatgcattcttttatttttatttttattttttggagatggagtctcgcttagtcgcccaggttggagtgcagtggcacgatctcggctcactgcaagctccgcctgccgggttcacgccattctcctgcctcagcctccctagtaggtgggactacaggcacccgccctatgtccggctaagttttctgtatttttagtagagatggggtttcactgtgttagccaggatggtctcgatctcctgacctcgtgatccaccagtctcggcctcccaaagtgctgggattacaggcgtcatgcattctttttagtttagtccctatggtaccatctataccattataaaataggtacttaataaatagtcaataaatactttaaccatttcttatctacatacaatctactttcttttttattttactttttattttgaagcaattttagacttagaaaagttccaagatgtgtaagaagaataccaatatacctttcacccagattcctcaaatgttaagtattttgccacatttgctttaatattctctctcttattctctctcccttctttccacctcctcctctcacactttccttcctctctctattcttttccttcatctatccacatgtatatgtatgtagatacatatttttttcttgagccacttgagagtaagttgcagaccagacaccttgtgtagttactaaaaacaaggacttcttttgtgtaaccacagtatagctttcaaaatcaataaaataatatttaaacaatagctgatgtatagatctgattaatattttggcaattgtcccaataatgtccttcagagcaaaagaaaatcccagatcacgtgttaaacatatcaagtctgttttgtcttctttgatctagaacatttccttagtctttctttgtctttcataaccttgatacttctgaagaatacaaggcagttattttatagaatgaccgtcagtttgggtttgtccagtgttttcttacaattttgtttatataattttggcagaagtatcacagaaatgatgtattcttcttagtacataatatcaggaggcacatgatattaatttgtcctattactggtaatgttaactttggtcacttggtttaggggatctgccagatttctctatggcaaagttactatttttttttcctttgtaattaacatatatcttgtggaaatacagtttgagtctgtgtaaatatctgtttctaatcaaactttcacacaggagttttagcatcaactgatgattcatggcatagtaaattattattatgattgccaaattagattctgttattttgaatatatatgtcctttgtttatatgtttacatatatgtcctttgtttagcttcagaattatctcctaattgtcttcgtcattatatgccttattctattgtacagtaaataacatttatttatttctcacaaataagtaacttcatactgaatacttttcatgatggatcatctgctatcctttgtttgcaatagcagctaaaagtagcaccaagtatattaaatatcactagcagaatagtttgctttcacataattttaggaaaaaaataatatctagaaatatagtattttgtgtcaaaattaccctccttgaatgaggcagtcaaagtaggtttttatagagcatctgtttgctgtcactgtttctttgaagcatcttgaatactattttgacactgttacagcaaagtattaactgatgcaacataaacacaatttaactcagtattaacaggacagtttgacaagccctattcaatgaagaagaacctacagccagggaaaaaatgcctagattctaatgcatcaacatagatattgttttgcctttttattatatgatgataaagtagaatctactagataaaaataaataacatgtaaatagatatttatatcaagactggatagtatacttttattttaagaaacacccatgcaatacttttagtctccagtctaaaaagatatttcacctcaaatatctattttattttatttctactatgtctattgcaatttagttctgtgtatcacatatttactgagtagcctgcctggacctatacagtaattaagtggtatgaagagtgtgtgtgtgtgtgtgtgtgtgtgtgtgtgtgtatgtgtgtgtgtgtatgttgcaaaaatattggaagaagtactttctttattttttattttttgtagagacggggtctcattatattgcccaggctggtgtcgaactcctggcttcaagcagtcctcttgctgcatgctccaccatgcctggctaatttttgtatttttttgtagagattaagtttttgccatgttgcccagactggtctcaaactgctgagctcaagcgatctgcctgcctctgcctcccaaagtgctggggttacaggcgtgagtcaacatgccagccagaagaagtacttttaatttaattttgaatttcacctgcaaacatctgcatgagatcacattcagagtaatgattcttaggctttgtagagagtgtggaattgttgtctaggtaagtttctttcattggttcagatgtgggcctcttgaaagggaacattgtagatgagatcatatgccaaggctacctcctcattggtgatatcctgtttcagttctcattatagttctaaacagatcagaaaaactttttttttttgatgattcattggcctttgagaacaatgaaaacatgttgttttggccttagttgatctcagggatgccattcctttatgtacttactttttagttaaaaggattcagcaactgtcagagaatcaaactgactttgcaatgttttggcatcttattgctagaactactgatagatatggtatctcaaggatgacatgcaaggacttttcctagttggtccccactactacttttcttcccaatatgatatgaggaattctgaattggctcttttgtaaagttttcagggtggcaggcaacacagtgacaagaacacttgtaaacagtttatttacattcaatggattatatttaatcattttatagttaatttgcgtaaatctctctctgtggaatgtccacgaaaatgtttttggttggtgacaagcaacatggtagagatgcagagagtcgtgaggcccggattgtagcccaagatctgttatcctctttctgtgtgatcttgggcaagccattatctcctctgagttggttttctcatctgtgaagaagacagattacaacatctctgaagctttacatcttaaagttctaaaacttttctgtttaatagttaaatatatataaattttctactcaaagttttttttttagaaaataaatgggattttggcttctatataagtaacaattatacaagacattgtaaatcccaatctatgatttataggttctaattgaaatacttctcatgttcatgtctgcatagtgccaacacatgtggataatgatgactttgcataagattttgtctgtatgagtttcagctttcagtggaaagctgggtagttaagaaccacactatccaagaagctgggaaatgacttattttgattaatcaaaatacaatgtacagataagctggttgagatacccgaatctgacaggacatttaaaataaactggcaaagatttatatgagccagtctggctgcagtgtgcacctggtgggttgtctggaagctttgatgaattagtagtgatgtcagaagacttcactataattctaggctagaatattgccatagggatgcagcagaggacatctggtttcacttcaatttatccatcagagccaacaatttgagtgctacagggacaagccctagagaagcagattttaataccatgcacctgatctatgatgggttcttatttttgagaatggatgggtatgtttaagtacatttttaaaaattgtagtacaaaagtaatacatgctcactgtaagacattgaaaactactgaagcatatacatttaaaatatcctcacccccagccaccccaactctcactctcctacggcagccagtataagcaaaattttatatactttattgaggtgttattgacattcaaaaagctgtatgtatttaaagtgtacaacttgatgagtttggaggtgagtagaggcctgtgaaaccatcaccacaatgtatgccataaacatactcatgacgtccaagagttttcttctgccctctttatgatggtgattagaacatttcacataagatctctttgtgaacttttaagtgtgtgatacagtgttgttaactctaggtactatcctgtccagtagatccgtaggacttgttaatcttgcataactgaaacttaaactttgtaccctttgaccaattcctcccagttttctcctcctctcggactctggaaagccactataaattttatatagatctttgtaggcctttttctaagtatcccactattatattatattattgtaatttagaattttagacttgactgaatgcagataattttgcattctgtggactgatatgaagaagccctttaatatttttcagtaaaattgatagtctatcagtatactcaaatatttgtcctgagcttcttgccatgggccagtcttgggcagttttctaacttaaatagtgatcttgcttaacctaagtcatgtagagcttgttcagtgttggataaggagatggtgaactataaatagtataaggatataatttatcatccaaactgggacattttgagagtccttaataattacactgggacaacaggtgtaagctgggaccgttggacatttggtcactctaaaagttgacaccagcacacttgggaccacttgctttccagttctgttccatggttcctcattcctgtgggatgatatagctgtgaactctactgcatttggtcattgaccttaaatgaactgatggttgatcgcctcttgccctttggcttctgtaatagagaaaccacagtatttcttagggagacttgttagcacccaacatcagactaagtttcttaattccataatcatctagtgtctgttctttccacttctcacttcctagtctcttctcagttgcctccagctgggcttctcttgccaccattccacaaaatcagcttttgtttatgccatttatgacctccatgttcacaaatctaggggtaatcacatctctgtcgttagttgatacagttgatcgttccttccttctcagaatatgttcttccccttattcctgtgactgcacgcttttccagcttctccccactttccagtgctgccttcttagtatcctctgctgaatgcttctctgcttgtcctctgtgttgaattgccccagggccctttcctacccacagtcacacttttgtggatgtagtaatcatcttcatgttggtgaatggttgtaccatgtactgaaatggaaacacagagaggagcaggtttaatgtggggtggggaagtggaaggtcaaaggctctgttttgggtttaagatgtctgttacaggcctggatgacaatgtcaagtgggcagttagatgcatgagtcttgagctcagtggcaggatcaggcctgatgagttctgtcatccagcctatgtaatttactgagcagttaatggcgtgctacacatttttggagttataattacagtttaggctctctaccttctcaccagatcatccctaaagcctttaacctggactggctagatgaagtgtcccttggtattctgttccaattctttctttctcatcacgctcattctctgtcatcctgtgagtcaccacatgtcccgtaacgccacaggcaaccattccttactcatacaagagcggatacattatcataggtatcttacaccgtgtcagcagttattcaaaagccaatctttaaattatgcagcttttctgcctcaactggtcttcatcagctgtttatcaccatatttctattgctaattgcataaatgaagacagatgcaggaaactctggatgtgggatgtcttctttgaaaacgaatgctgctaacgccattttcagaacgtctgctacaaaattccttctataaaatggtagctatcacatatgtgtgtgaatgtatgtgtatatatgtgtgaacacacgcagacacatacacagttggggttgcagctgttcctcacagttgtccgataatctgttaactgaggtagtgtccatacagtttctttgaggcataaaatgattatacactgggcagcaaaactgcagcctatttttctactctgatagtttcatttgtgttacctcttcaagaagaagattagaattaaattgactaggcaagcaaagctgaaaattgaattaatttcagatttgtaataaaaaatgggatctctcctactcagtgttaactaggaccctgtaggctatacaaactaaactgacagtctctcattaaaatgatattttctccagtgaaatgtactggcactaaatagtctctgaaatgctttatgctgcaggaacacagctgccttcaggattatggaactgagagcagttttcatgaatcccgtggaagccacagcatttattaaattgttgcaattttaccaactatttatgaaattcctgctttgtgccagacattgtgctaggcagtttggataaggaaggtagttcatgattcttgtgatgaaagagcttccaatctaataggagaaagtgttacatataaaacgaagcttgaagtgacttggttagtggtgtgagagaagtgctatggaaatatgaacagaggtgactaattctatccagttggtttggataagaaggaaatgagtaatgagaggtgtggactttgaaggatttcaccaggaagaaaatagtcatatggaacggtgaaaattataaaacatttcatgtcaagttaaatactatggaattaattcgatttttactatatggtttgcctttaaggagatttgataatttcattccaagatacaatttcccctaaactgaggctacctttttgtttgtaagagtggcaaaaatttactgaatgcctaccatgtgctgtgtgtgtatgtacattcccttattctacacataacagcagctctgcggtgtagttaacattgtcaacagtagatgggagaggtcaggagacttgtgcatggttacacagctggtaagtggcagagctgggcttcacacccaggtctgttcctctgcagagaccatgtgtttctcccacagaacactgcctttctcacacaggactgttaacagctgtgactgctggtcgacgagggtgatgacattgtcagagtccacgtgtacaattctggattaatttaaccagatgctacatttggggaagtcttggaaccaaatacttctcagtattttgttgacttgatggtctgagagcttaggtgttggttaggcccagggtagggcaacactgacctttccttctgtcctcatgtccgaaagtgactggatcttggaggatgagtcccagttgctaaagagagtggtaagcctctcagtggccccagatgagctgcctcaggagtgccagcctgtgggcggctgggtgagctaactgtccagctagaggctgtggctctcccctaaggtactaatggttaaggctgctggctatatgagagatattttctcttggaagtaaccagagctacactaagtgacctcagtccttgaagactagaaggctccactgagcagtgaggctgagcatgtagcccaaagccggggcagcaagacactaggacaagtttcagaactgcgttccctgagcacttctatgtgcccacctcttttctgtcagtgttccaagccagactgtcaaattgcttatctcagatccgtaactgagcccagtcttcccctcctgggccagtggcagatcatgcctggaaggctgagctttcttccacccctcatcattcaagaaaggaagagacattattcatctttggaggggaatttcaagactaaaggagatgtatgaagtattggtttctgacatctatgtctctaggcaaaacatcactaggcaattatttccaatttacattgtctaagctctcagatgtccatggaaggagccacatttctgtctctcttctttcatctactgtatttacaactgggaacttctttcttgcagctaactttaagtttgcacactttatttgaacatccatatctgtttcttctgtgctcaggaattatgaaattagcgcttctcctaaggaaaagtatcacagaattttctcccagaggcatcttagtgtggcatgagagcataagctttggagtcagatctagattcaaatctgtttctgctacataccatcaattcgatttgatgactggcacagggcctccttttttcttgttcctttgctgtcctcaagaagtggctgctcccactccagccttcatgtctgcattccagccagcaggaggagaaagaggggcactgctaagaacacttcctggaagttgcacacatgacttccattttcatcccaggggccagagcatggttgaatggccacacccagcagactccaagggaagctaggaaatgtctttattcttggcatttatttctgtaaaagaagaggagtgattatcataggttgagtttcctaggaagcagctctgagacgaagttcagcttgcaaaatgtttattggatcagtagtgatggaagggagggcagagagagaagtcaggatactatgcaggctccacaggatggtcaggcctttatgttcctacattgatcagtcattaggtacaggccattatgggaagaagggtgactgtgggtgagggagccgttggaagttgaggtgatccctgaagagcctgacagacagaggccttctggccaacagcactaccagcaacatatccttcatggaagggggttctggatggtttttagcctacatcacggggagaatggaagagctagcatctctgctacactacatcatagggtggttgtaaggatcaaataaaataaaacatagaggtccttttgcaagaggacctggcttatggtaagcatccaatctatcttagatgtggtattagcatttcccaaagttatttttacaagatgtttttctccccgaggatcttgtgggactaaaagagttggcatccctagtctaatgatcaaatttagaaaatagtgtattgcaaaatctttatcttctactctgtgtggattggtctttagtcaatgcttctcctaatgacttgcattagaaaagatagtgttgacattgcttttgcctttgtttttcacccaagtggaaatacagaaagtgcttacaacatgtaaaattctgtattgttgacattcattacttttgttaacaaatgtgtcacatagaaatttcctgaaaatatgatcaaaaaatgaaaaagcaaatacttagtgagcagacatgcagtggggggaccttcctacccagtgtgagccagcatttctcacctgtgcctctatagtagtctaactggtgtgccagttcccactttttgctccaggtatagtctattcattatggtagccaaaataagcctttaaaatttttaaatcaatcttaccaattccttttactctcaacccttgctgcccagtgtattgacagtgaaatgcggagtccttgccattcctcgctaggccctgcaggcactggcccctagccacttctctgaccccatttctgtcccagccattttgctctagccacactggcttctttgctatttctcagataaaccaagcaagtgtctgactcaggacttttggacttgttctttcccgtgcctgaaacgctcctcccctcgatttggccttggcttactccctcattttgtgcagatttctgtgctcctcctaacctcattggaggcctttcctgacctctttatataaaattgcacctcttgtcaccctttatctctctcaccctattttattttattcatagcacttattacaacctaaaactgtgtatttaatgtttattgttcattgtatgaccagactacaggatctaagagagcagggcctttgtttttgcttattgctatatccccaggagagtgcctggcttcaagcatgcactccacaaatttttgcaagtggaggagtgagtgtgctggattctggaagtacagtagtaccctgcccttgtggaatgggaatatatagtctacaactaaaacccattctaacagaagatgcaataaaaattatagaattttctctttaaatatattattgttgtaaatacccatagggtttctaatattgagccatccttgcattcctgtgacaaccttacttggtcatgatacacaattattttataataatatactattcttaagatttggtttgccattatgtattctatttaatattggcaagtaagaatggttttctgtagctttatgatgtctttatctagttttgataaccataagccttatcctggttataccagcctcacaggggttcaacctgccttattttgttgttgttgttgttgtgttttgttttgccttaggcttttagcagcccaaagccatgttttttagtttctgactctagtgataagtggaaaaggaggaggagaaaggggctttattggcccaaccagaaacagagactaagaacccatgactatattctctcccttgtcaagaactctgttaatctaggttttacagaacttgcctgtaaaactgcctgggctcggtaccttcgtgttgggtagaaatttgtctttatacattttgcgattattgccccatttaattagttcccttttcttgagtcagtttttatacttttattttctgggaaagcttttatctatatttttgaatataggtagtaggctcataaaatcttacacgtatattttctaatattgcttatttgtgttttctttcactggttttaatcaagcttggcaaatttttttctactgtattgttgtttcatttatgatccctttgatgaggggatcattagaagccccaactccagcattatgcaatacatgcaggaaatgaacatgcacatgtattccctgaatctactagaaaaaagaatgtctcctccctcccctcctgtgccaccccacccccacgtcctgtttctaactcaaccttggatattttacaacatatattcagtttgaaagctaatactgataccttgctttatatgaacatttgtatactgggaccctggtgagggactgacttcattgggatagtttatggcttaatgcatctatgtgacttatgtcttgttttctctaagtatttatcctaataaatttaagagattctttggtttaaaaaaaacacctttgattttgttcattgagtctactttgttgttattttattccgtttcattagggtctctttttattctaccacaattgccagagtaaggacagctttattgccagctgcagctttgctgtccacatcgccctgtgaggcctggagtccccaaagactctaacctactgatatttgacctcaatactcacagaaggaagtctgctagccctgaaaatgaatacttcctttggtgcaaatcttaaggttttagcatggagccaaatgccttctcactgccagcaaattatttagggtgggggtggaggagttgtgatggtggagtgatggagaggagcctataagtagtccagctgctctgcaggatatcatttagttgagcgtcctgatggcttcttgactctgagcttggacttttatgctcactttttattgcaggctttttgctttgggttccatgtaaatctgagtccttcgctttctgtcttccacatagacctcaaaacttttggtccactattagcaccatttctcagtacttaatttttaacaaaacaagacactggtatgatcttgctttggaaaggggaaatgtaattactatcttggtgtgtccttatggtcctcatttaactcctgtattttgtcattggccatgtgggagagatgggagtcatgagttctgttgggcactggaatctttttctcaccccagagtgaccaatctgccctcagcttagtgatttcaggagcaggaggagccctttccatggctgggtacatggagtgttacattaatgggtgcttgctcgaaagtacccatgttttctttggtaaagaaactatcttaaaatccaagatgtgggttatttgagaatatgatttatttatagcaaatttcttctgacatcaaaatagacttctgaatgaatttaataaaatttttggggaatatttacatatgaaaaaataccactggttctattttaaaatctaagcttgtagagaaacaaaagataaagaaaaaatgttcagctctataaaagataatctaggcattcatcacctaaactttcaaagagtggaaataatgtcttgactttctgttttttcttcaactgtttggggtcatttagacatgtcagggtaagagtttttttccatttatatgtatctgtgaatctctaaatgtttagcttatttgggattatgtcagaatgtgcaaatccagaattaattctcaaaagaaagtgagataaaatcagtttaagatggcaagtgaaggatttgtataagatttcattaaagcttattaaatgtcgaaatttattcctaaagaaggctctgaagtttgtgctaaatatagaaagagaaggaggaagagagaagggggagaggagagagaaaaaagagttttctgtctgggatgaggagaaagttgtacccccctcccaaactggggctgaactataattctgaccctcaaaagtcagctacgtttccaaatgaggattaccatcatggccattttatcactctgtgcgagatgctgacaccatgcactaagttttgggtcccatgtatttctttttattgtggaagagaaaaaactaaaatataattagaagtgcattgttaggccgggcgcagtagctcacacctgtaatcccagcactttgggaggccgagacgggcaggtcacaaggtcaggagatcgagaccatcctggctatcacggtgaaaccccatctctactaaaaaaatacaaaaaaaattagctgcgtgtggtggcgggtgcctgtaatcccagctactcgggaggctgaggcaggagaatggcatgaacctgggcggtggaggttgcagtgagccgagattgtgccactgcattccagcctgggtgacagagcaagactccatctcaaaaaaaaaaaagaaagaaagaaaagaagtgaattgttaaattaataaatatatcaaatatataaaataactttccttacactctttacaattatgatagtaagaatgaactaacactttacactttcacctgagaaatgacagagcttcagaatttgatttctttaactgtagagtattaatgaaatccaagatggtattttgaatgaaagaaccaacaggaagaaaaagccattttggtgacagtctcatgaacttgtcagtggtagaactagggaagataatacaaaagttttgacatctcagttgcttgccaccctatctgacatggcactagcttgttcttttagaatataggaaggaggggctgggtgcagtggctcacgcctataatcccagcactttgggaggccaaggtgggcagatcacctgaggtcaggagttcaagaccagcctggccatcatggtgaaaccctgtctctactaaaaaaaaaatacaaaaaaattagctgggtgtggtagcgggtgcctgtaatctcagctactctggaggctgaggcaggagaatcgcttgaactcgggaggtggaggttgcagtgagccaagatagcaccattgcactccagcctgggcgacaaaagtgagactctgtctcaaaaaaaaaaaaaaaaaagaatataggaaggagggcctggtgtggtagcttacacctgtaatcccagcactttgggaggctgaggcaggtcgatcgcttgagctcaggtgttcaagacaggcctggacaacatggcaaaacaccatctttaccaaaaatacaaaaattagcggggtatggtggtgtgtgcctatagtcacagctacttggaaggctgaagtgggaggatggcttgagcctaggaggtgaaggttgcagtgagccaagatcctgccagtgcactgcagcctgggtgacagacccagtctcaaaaaaaaagaaaaaaaaaaaaaaaagaatatagtaaggaaggcaggagggaggggagagagggagagagggaaaaaatatctttacaaaaatttaaaaagtggaacaagatgattgtaaaaccttcaaatgatacggaaatgtacaataatacagagttaggaggtgggactcccactcccacctcctaattcggctttccaaaggtccctactattcacggttgtatattcttcaaacatttatctgtgtagaagctaacacatgcatttagccaactgagaggcatttattaataatcgtttacagttttttactattacaaataataacacaatgaaatgcctttttacccattagtataatatctattgaaatgtaattagaaatgaataattagttagatatgataaaaatgactttcagtctgtaaggctaaacaatttactagactagattgttcaaaaatcagagtgatttaatataccttagcttttagaatgcattggcaaaaatgacgtttgtagctttagacttgcatagatagatagttgactgtcccagaaatatttgacctgatacagagatcttctttgcacatgcttgctttctagagagggctgtactggagtgagtggataataaggctcttagttcttcctatattctctattcattctccccagcaattaagggaactgtgtctataatattggagatctggaggagaattcaaggttaaaaaagaaatacaccgttattatgttaattgtctaagataataataattttgattccttagggaactacctcaaatgtactacacagtttttgatggaatatttgcaatctggctataaatatggaatgataacggaatgagatattttcatagaaacatagtaaaaggataatgctgaagaataaactacattatggcttgtgagtcacacgaataatgatttgaattatgtgactgtggaattgttgcatgagtataatagatggttcattcttgcctctaagcatttgacatgctacttattatgaaggttcaaatcccatgcttatttataattctttgggcggttaagaaaggaattattagctctggcatcctttatttgtatgtaaaaacgtgaaaggtaatactatatggttttctgtataagaggatatactactgaatagtaaaaataacaatttacctttattaagtacttactacctgcctgcattgctctgagcacttaaacatggaatgatcccaatgacccaactatatatacatatctattattatcccctttttacatgcgaggcatagaaatggtcagtatcttgcccagggacacacagctagtgagtggcaggctggcataagtgttgagagacttttctggcagtggtgatagatttgcaaggagccagtcatccatttacattcttgtcgagacccttctgtggccaataaatcgcatggattttgaaaaaagtgattcaggtaagaagatgcagctgatggctgtggaatgggaaatagtgtcattctcagataattggtccacataggaattaaaatattaccagcatgcttaaactaaattatgacacttgcccaaattatggcagtcaccctctacttcacctgagtgaaaattttgaaatctaattgtatctagacagtactgacaaatcattgaagttagagattgctaaatatgttttaaagctcatatctaatactaaaaaacatacaagtgttatagtgaaatactagcatgaatttacaagtataaataaatatatatatgtatattttattctattttgagacagggtctcattctgtcacccaggctggagtgcagtggtgcgatcacacctcatgcaggcttgacctctctgggctcaagtgatcctcccacttcagcctctcgagtagttgggaccacaggcacatgctgccacgtcccactaatttttttatttttttagagatggagtttagccatgttagctgggctggtcttgaactcctggactcaagtgatctgcccaccttggcctcccaaagtgctgggatcacaggtgtgagccaccactcctggactacaaatatatcttttaaatttcaaattgttaatattgagttaccttttctacttttaattacagtgcatgtaacaaaaagttttctctattttatgccaaccaaattgcattctgtattgtattgaaactaggcacaaagtaataaaacatttaaaataagtctatgttctaactaagttttattttgaatttccctatcacttcaaaagtatcttttctgtacgtatgttaaattttacttcattgttaatcttctttgttgattagttcttttccctgatatttccctaatagtaaacaaaacctttaaaaatatttacaaagtgtcattttatgtttcatgaaatattattttgggtttttaaagtcaaatttttatattgggaagcatgataaaaatgagattttagagtaattgacattttgaaatattagagagatttcctagggaaattgaaaaagacatgattttcctaaattggggctattttattttcctgaatcaaattcaggccttgcttttacttcttagatcttgttctttcttctgttccttctgtaaaccaactaagacataaacactgattatctgttactttgttcttgtatgacttctcagttttttgtaacgagtatcatgaatgtgtctaatcaaatcataaagggttataagtatctctattagacctacttgtattttttttttttttggctaaattctgtcttcttgtcttcttctctaagatgctttagtattcctaccctcattcattgttcatccccacccacctccattttgttttaccctcttactcattgattaaaggccataacctccactagtgagaatgctgggttcagacctgtgccaccacttgcctaccgtgtaacctatggtgaaaaccaggcgtctcattcgtaaagagaagaaaaggttagcacctaatttagggctgctgggatgattaaataatctgtgtaaagggtttagcttcctgtctaatatatagcaagagcccagtaaatcatagctgtttttattgctgtcattgcccaattagctctgtccttgtggaatattctacgtggtagggaagttaatataggtatgtatgcgtgcatatattatagtcgatcagtaaataataactaataaaagttacatcatactgtattacatcctacatagaaaatgctttattacaatgcctgggaaatgtcatttactgacctcatgtcttatctcataaaataagaaattattcatattccatggcaattgatgtatatgcatatttcttttttattgttctggatataactatgtaatgaaacactctgttatattgcaagtaaaaatcaagcttaagtctagatttttaatttatgctttaaaattttccctttagctagtgtttcaaataacattcagaacatcacaaattgttttctgtaataccattaggtcagtttgtacacagcctttaaaagttcttttcatatctggaacaaagctgtagttgattttagatttaaggaagtgaaatagagacatataccttttctcaatctaatttaaaaaatttagtcaaatgtggatatctggtgtggcaaggaaagaattgtccgtgtaattagctgtagtttatgctgaattgcggctagtttgaaacgactgtgatgattatattcactgaaatgtttttgaggcttgattttttaaaaagattttgagaagacaagatttttaaaaatgagattaaaataattcttactttcaccaccctaaaaattgactacagtattttctttttgtataatactataaatatgtatcattgatatacttgtaatgagactgtacatgctattttgtattctattttctctcatgttaatataggtaaatccacattgcaagattttaaatatctgcacattagtgtattattatgttcatgttccataatttattgaactgtttcaatttttttttgagataaggtcttgtggtattgcccaggctggagtacagtcgtgatcatagttcatggtagcctcgaaatccagggctcaagtgaatatcctgccttagcttcctaagtagctaggactacaggcatgtgctactcatgcctaattatttattttttttgtagagatggggatcttgctatgttgcccaggctggtctcaaactcttgggctcaaatggtcctcctacctcagcctcccaaagtgttgggattataggcatgagccactgcacctggcctgaactgttctttaatgttagatctttatgaagttgtaaatttttaaatcaattagcaagcaactaactatattgtgcctatcacttttttgctatattagaataaatatttatgagtagaattaccaggtaagagtataaatactaataaaccttttgcaacttgttaccatatgtattttcaaaagtgttataagactttaccgtaccactaataatgaatttgtatagcctgctttgccaatattgggtgttacacatctgaccctcaaataaaatgggacttagggatgctacccccacccccttgcggtgaaaatccaagtagaactttctgactccccaaaacttaactactaatagcatgctgttgacaagaagccttaccaataacagaaacagtccattaacacatattttctatgttatatgtattatatactgtattctttttttttaaatttattttaagttccaggatacatgtgcaggtttgttacataggtaaatgtgtgcacctatcaacccatcatcgaggtattaagccccacatgctattcttaaaggaagctagagaaaacaaattgttaagaaaatcataaggaagagaaaaatacccttacagtactgtattgtatttgtcaataccataagagtacatcatctgtttacaggatgaattgtctgtctgacatagcaggcaactgcagctgcagacctcagtctatggcaaatctcaagcaattcaccattttcttgtaatatgatgacttttctgtgcttctttgggaacacctccagcctagatcactagtggcacttcacagggggtcccacagtgttatttcaggtttatagtattgcactaaacatgatgaaaaatacgagagaacttcaagagatttccacccccccacacacacactttttttttttttttttttttttaagacggagtctcactatgttgcccagactggagtgcagtggcgcaatctcggctcaccacaacgtctgccacccaggttcaagtgattctcgtgcctcagcctctcgagcagctgggattacaggtgtgagccaccacgcctggcttatttttgtatttttagtagagacggggtttcaccatgttgccaggctggtcttgaactccggacctcaagtgatcctcccacctcggcctcccagagttactgcctcagccacccaaaggtgtgagccactgtgcctggcccccatggccttttaagggatactcacaacacttaagttcaccacaatagcaaagtactacagaggtacagtgtgcactatagttaattttatgcagttatgatttaatactgcatctttatatgtgtttacatttatctcgactgtgaatgattccatgtactgtctgtgtgtaagttttcataagttttaatgttttattatacatttgtataaattttatggtagcaaatgataaaatagaccagtgtttacatatactttttgcattcatgacatatctctttcttaatttttttcagtatttctaggctacacggttcatttttgagttttttcaaattgtcacaaatctccaaaaaaatgttttagtgtatttactgggaaaatttgagtataagtgaaccagcacatttcaagcttgtgtcgtctaaggatcaactgtatatataaatatatatatatatatttgtatgtgtgtgtgtgtgcaatttagggcatggttatggccaggaggaagtggagtggctacccagggtgttggggtaaaggagctagaggtggagcggccacccagggtgttggggtaaaggagctagctgagagcacccattgtagggagccttctgttttttctggtgtaatcaatttgagaagtcccaccggggcagtagaggaggagatggctgggccctgtggctcctatgcttattccctgagtgtctcttttccctggaagttttctctctgccctgtcttcaaggagggtcattccctaggtctctagtcccagcccttttttgctactcttatcttaaacaccttagggtagcagaaagtaccctggactgaggtgttacaattcttgacagcaaacaatctaggtatttacataagcagaaagtcacttattgaagggtattgggacattcacaggatctctaggagagccaaagaccacacaacggagaacagtgctcagccacagtggggtcccctcccctgctcaagtgctgctaccgcacccgctacctaccccaccagtgggttgtggtgaaggaagaatctcctgtaccctttcaggggacatagcggtatagggaggtggacagtttacacaaggtagaacccacaacacacattcctctccattatactgagtttctggcaaatattataggactccattgagtccagatttcaacaaagaaatggagcaaacaattagaataattcccagatgctcgagtttccatgttgaatccagaggctctgttaagacagctggtctctaaagcccaggttaaagtaatgttctcccctttcctcggaattcattcccacacaggttccccaaatatatactggacaagtgaaacttgttaaacatatacaagtttgtaagtttgcaaaatagtgccattcttttggtgtgtaagcctttttctctcgggcttgactctttgtttgactcccagtgcagttgaaatctgcctctgattatggatctgggaagagtggggcagggagaggttagaacatgagaagacttaggttctttttgaaagatgagtgcctcaggtgtgcccactgaggtctccaggccaggcaggcactgcctaagtaggttcagcagggcttcggggagttgtgcagtgtgcgttggtgggagagaaagcgggtagggggctggttcaggggttggtagttctcgaagtgaccaaatgctctcattttcccatcaatatcgtttcatagaaatacctgacaaggctcccatggtctgagccttgtcaatgagatgggtgagggttgggggggggtctttgtgtgaacccagatgtcagtttttaatgagaatttcaagtatttatattttaaaagtaaaccagaggaagattgagttatgaaaagattgaattgtagtcatacagacctaggtctgaatcttggctctgccacttaccagctgtgtggcctgggcaagttccttaacctccgtgagccgcagtatgtttgtctgtaaagagagataagtttgtttatcctattggattgttcttgagcattaaatgagataatgtgtaaagtaccgcatagtaattgatcgataaatagtagctaatgtcactgaatgattaataaatgcttatggaactgaagcaatctttagcaataaagtggagcattttgctcatggggaacttgggagtcgtgtctggagatgtctcagtctggggtacttccttaagatctcaaatcagattttataggaggtttgtttcacatgtttaaggtagcctgtgtgtttaggtggaatttgttcaagtgtccattgtcataaatttgtttaatatcattgctccttctgcatcaatttttaggccagacctaagttatttgaaacccggttgtacacaccccgtcccccgaggcctagttgaaacttccctcacctgtgcggtggtttctgctgtagcctgcctgttcctcatctcgcagacccaaaaacccagcacaccccacagctgttgaccatgatgaaacctgatggtcaacatcagagtcaggtaaattagaccccctcccttcgcacgtgttttctttaaactagccaaccactgccctgtggaaagcctacggcagaacacccgtggaccttaataaaggcttaggtcgccaggttctcgctcactcgctcgctagctgcccacttactggttgagcacataggttccagatggctcccgcttcctgttggcctgcaaggcgggctgccctcttctctctggcatctgtaagtaacaccggcttctgttatttcatgtgttttgttgtgccggctcctgtgtctcacttgaacctaactcccttcctggtcagggctggacccaggtgagagaagatctacaagggtggctgccactataaccgagttttctgtgagaggggcatctggtcatgtgtccacgcttaggattaggcgtccagctgggaaaagaggtattctgtgagaaacactataaacatctggggccgccccccgccccagcaggtctagaatcgatagctactctccagagagagacctcaagaccaagttagaggaaaattgaagcttagcaaaatgatcaaacaagatttcgccaaaataactggttatttggctggttatattaacttgtctaatagaatggcttatcagtcattttattggaaattcctgttgttttggtgtgaaacggtggtgaacactaattggctttttgaaaaatagggccaaactcttcagaacatatattttaggaatcaaaacattatttctcctgaagtttttattgactttattgtttaaaatacatgtttcatttccattggctagatgaaaaatggaaagtcatttctgactggttggagttccatagacttaacgctgaatccaatggttagtaacattggctttctattcccttctccatccgccccaccccctttgccacttgcttacatttcttaataaaatgaggcaggtttgctatctttttgctttttattctttcttatatccatcatctgttatcctttctctttcatgtgttctgtctctgcttaattccttcagcactttggttttattccaataaatagcttctggaagatacttgcgtaaacaaacaaaaacagcaaaaacaatgaaacatttaatttttagcaagtgttatggtgacctttagaaagaatgtgctttccggccgggcgcggtggctcacgcttgtaatcccagcactttgggaggccaaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattacgccactgcactcccgcctgggccacagagcgagacttcgtctcaaaaaaaaaaaaaaaaaaaaaaaaaaaaaaaaaaagaaaaagaatgtgctttccaaagtagacatgggtgggacgtaactggcccacctgatgttgtcttccgtacttgtattggttttcttctcttcttctgtcatgtgccagatactgtattggatgctttacaaactctaccttatttaattatatcctcatgatatccagaagggagttaatattctcatcttgcagatgagcaaactaaggctcagacatggtcctaataggtagaatagaaggaatttgaatccagagttaactccagcacacatgctgctttccttaccagggcttgcttctacctaaatagtaagtacagggagagctttatgacacagaatatctacaaatactgattgacttctctggctcttggacccaaatgagaatgagcttcatggtatgtgtgtgtggtggggattcatcttatttttgcaatgcgtatatgtgttgtatttttaaatgatgaaaaatgcacaggtaacctgtacaagagggagatctaagaatagtcagcattaagtaaatatttgttcaaagaatgtcttccgatgacattgcataatttcagttcatatatctgaaaacttagtaatgactagtgatttttataagagagattgaatagtgggcacttatttctaatgagccaattgaaaagcaaattagataacttgctgtgtgtatggtgacaattcatccactttctattttctctcccactgtcttcccacatatgtatatattgttttcattgacatattagtgagttaactaggttaatttttattgtgcccagaaaatacttaggtaatttcagattcattgtggagcggggaagcaccctaactctgtgagctgtactctgaattgcagagtaagtttacaactagtgggaaatataaacattgacaatatttgcactcttaatctgtgtgtacaacaccatactctattgtcaccacccatttcacggctggagggtccattcttgtatcattcagataccagcatttggaagccaaggacctacattttaatagacttagaagcaagaaactggttatatttttgacgtacttatcaccaggctttcccacagttgatcattcacatccatattagtatcaggaccctattgtgtatagaggacattggtaacttaattttcctttttttttttttttttttgagacggagttacgctctgtcgcccaggctggagtgcagtggcgcgatcttggctcactgcaagctccgcctcccaggttcacaccattctcctgcctcagcctcccgagtagctgggactacaggcgcctgccaccgcgcccagctaattttttgtatttttagtagagacggggtttcaccatgttagccaggatggtctcgatctcctgacctcgtgatccgcccgcctcggcctcccaaagtgctggaattacaggcgtgagccaccgcgcccggccggtaacttaattttcaaactttgaagcaaacagtcacaggcctaagttattgcattatcaccattcagcatttcttctgaataaatattacaaaaaatataataggtgtgaagagaaattcagagaggtgagggaggacgtgtagggttttcagctttatttcctgcttctcctgagttgcacgtgggaacacagatgatgccagtacatgcctgatcgggaagtgacggcacagttacagtcctgccggtatgctcacgcaagtgggtctttttctcatctcttttgaagataatttattgggaaggtgcctacattctgtccagtttgatttcaacagtggtttgccaaaatgagaatgagtccgaatttctcactgaaatctatgtatcttcaaaattaagaaatccagcagtactaccccttcctcttgtacctgtgatacaagtttatccatcattgttggagttcaccagcaatgtaaaccctgaagttgatcagtttgtccccacttctagttccagtcagtggattctataattagaagaaagaatggctgaggtactataataaaatatttaccttaaacaaagccacaccggtatcccttttgttcttctctccatggctctgggtaaacactataactgtgatgttagcctgcaggctagagccaagagaactgaagattgacaaaaaaaaatgatactggaggttcagtagtgtccaccctaccgtttgccctccgcttgtgaagtccagccctggattatactacaaagtagctgtgctcttggacaagtcatttctcctctctggctttggttttcttcatatctgtaaactgagagggtgggatgagattttacttgagtttccttttagttctgattctatgaaggagtaacatgtcttgtttgactcagaaaatcctggcgatctctttcaggcttattgtagtgtttattacagcaagctctttagaagcttccgcataagcagacatcagaatgcgcctggacctcccaaagtcatctggttttcttcagttttttaaaagttcagaaatgtgatttgtagaaggagtaatagaagggagtataaattacagtgggaaatgggaaaacattcatcttaaagccatatatttctctgtacccttttgacatgtaatattttcttatttctattgtgttgggcagaatgaaaaatgggtctcgatatattttgtccctttaattgtagcctaatttattaatgccccctgggcttcccctatattattggtggcagtttctctttttagtaagtcattatgcagatctttggggatgactgtcaaaatgcttaataaaaacttgatagctaagctaacttttgatttggggctttgaataggcatccgatgcccctgcaatctcactcctagatatctgaccaagtggaaaacttattttcacacaaaagcctgtctgtaaatgttgatagcggctatatttgtgattgccagacacaaggggcacaggggaaatttggaggtgatagaactgttgcgtatctgcattactgtggtggttacatgatcacagatgtttcaaaactcacagaactgtacactaaagggtgaattttcctgtatgtaatttatacctcaatttaaaaatgtgaaaaaatactgctaaaaaagtttatttgaagtattttttatacctaatactatgggcactttgggataaaatagaaatacgctatagaaatacgacattgttcacaagggccttttaaggagattgaaatttaggatttctaaaaagatgttatgaggacatacggattattggaagtagtagttacttctgtcagacaacagaggagttataaaaagcaaaaaaaagaaatgatttttaaagttatagcatctgagctttttcttaaagttggtttaaagtttttgatctttaggcttggtggagtggctctcaactataatctcagcactttaggaggctgaggcaggcagattgcatgaggccaggagtttgagaccagtctcgtcaacatcgtgtaactccatctctacaaaattacaaaaattagctgggtgtagtggtgcatgcctgtaatctcagctactagggaggctgaggcaggagaattgcttgaactcagtaggtagaggctgcagtgagccaaatttgcaccactgcattccagcctgggcaacagagcaagactgtcacaaaataaaatttttgatctttcagcgtttgcagggcagtagaggggaggagaaccaagtcataaaacacggatcaactttattttcctgaagaagtataaggtaaatatgtatgagtaggcttttttttttttttttttgggtcccagcatatcgtaactacttttgacaatccctgtttctaataaaatgtatgcaagcatatctttgtatatttaattttttctgtgcaattcaaggaaggcaaatggttactatgaacactaaatcctgtcgaacttcctcacacgcccgcaacataggcaattgtttcaaaggctgtggaagagactgccagttgcctaccaaatatctattcttcccttccttagcaacagtaccccagttcttttcaggaaagcaatgtccctgtaggaaacattggccagttttcctttgagccagatgtggctggtgactacataagtgttgtggacttccaggaagcggggctggtttggtgagtaggggcagcagtggcagaacttccccaactcccacctcctggtgcctggaatgcagctgtgatggctggaactccctggaactccagcctaggtcttttctcttccttcccctagcccctcaatagcctactaggagacagttctccttctcaaagagaaagtgtctacttgacagttgatggaacagttgttactggtttccctgaaatagctcttcggtcaattcccttgcctcacctcatctaataaacatgaaaactgacccttaataagcattttccactttgctggcagtgtactaagtatattccatatattatctcaaataaatcttatcccagtgaagtaagttgtgttattatccccatttcggacaaatataaaggctaagatagattaggcagctggccctgctgcttggtcatgcagcaggggagctgggatttcagcagaggcctgttggcttctggactgtgccattacactcagctgcctattcatctttactcaagtccctgttaatgtaggtcactcagaggcattaaaacaccaattcatggatttctatcgcccttttctctgttcttattattgatattatacaaatttttcttagcaaaattcttaatttgaccccttgctgaccatgtgatttgattactaaaacgttagttctcagtcctcttccctggcagaaacatctgagggagtagggacaggacggggaagggtcaactcagttcccttaattcagatactttcagcacccctctggcttctgtaaactggctcgtcctgatgccccctaaaggatcctgtctgcctaatgttttttctaggaaaacttatcttaccaatggcccttgcataatgcccctttttcctttcagtggagtaaaggctgggccacctgtaaatggttagtgcactcagggattaactttaatagtaaaaaggtcctaagcattcttaaacaagtgttcagcttacaaaaattgtacgacattacgcttacgtgacaagtgtaatacagttgtttggtttagtaaatgcctaaaggagggtcattggagatgaatttgtagcttcagtaggttctggtaccaagaccagccctcatctgtatgatggcaactgaagactttcaggatattgattaccttaagaaggaatcatttgttaattcactgaccacactaggtcccaccgacccagccttcttgaaactcctttacctcagaattttaccacgccattcttacatagtactatttattcgtgtttttttgtttgtttgtttttctagattggttttgctttaacttggtcttaagcttctggaggatataaaatgagtatagtgagtttgttttcacactactataaagaactacctgagactgggtaatttttaaagaaaataggtttaattgactcacacttcagcatgggtggggaggcctcagaaaacttagaatcatggcagaaggtaaaggggaagcagggcatgtctcacatgtggcaggagagagagcatgtgtgaatgaggtggggaggtgccacacttgaaaaccatcagatcttgtgagaaatcactatcacgagaacacaagggaaatctgcccccattatccagttaccccccaccaggcccctcctctggcgtatggggattacaattggagatgagacttgggaacacagagccaatatcagtgagtctcatcaaatacacgtgtgggggaggaaaagggaagaggggaaggaggaggatagggaccaatttaaaaagcatggtgtagcatcctgccactgccagcaaggagcatatgcccccagggaatgtctgggtctggcgtcctcagtgggcctcagtactgtacagtcatgtacatatgccacatgcactgcgctgccccgatggtgctctaaggaactgactataagcaaactttagtatctagcccctagcataatatgtgatttcccccgaattcaatacttaatacttgagtgagcctgattcccaggtgaaaacgctgatgaatgcagaggcatagattagggtattaggcagctacatcttaagaatttaagaacagtggtactcattcagcttaaaaagctgcttctgtggaatttgcatgatttctctttcatggacatactcactggtgggctacaactgttggcattaaaaatccagcaccaaaatctagatgagatgctttcatcatctaaatctcaaaacactgaatacgagataaaattacacaaataagtctttaaaactttctcagagaaaaattataacaaggatttcaaaagattctgaagggaaataaaggcaagtatgatacaaaatccgtctaatagtatataagtaaaatcccaagatatcatatctatctatgacatctctctctccatatctacatctaattttaaccaaaagaaatctccttgggaataagtctgattaatggcttctaaaaatgactgaggaaatatttcctcctgaatttccttattcagtctttactcattactctcaaaataacacaataggagcctaaagaagctaaatgacctatttcttcagagaatccatttcttaaagggaaaatgaaatattcccacttcaggtggaatcacatttatataacctgtgcattttttttgaagtgtattgagtaaagtgagcgcttttttgttttggtaagttttttttttctttttttttgtaaatggaatcattttaagtatgctgagagcttactatcttaaaggaacacttaaatcctttcataatgaaaattgagtatattaaatgtgtgtgcttgcatacacgagcgcacacacacacttaagtgactgttagttcagtgccaaaagacttacagaaacagggatttaagcatactaggcatccagaaaaggttatggggatctacaaagcgcctacttgggagaaaatgttgtgtttcttgtggtaacataagtgaatgcatagaacaaaccgttttagagcaccgccaggctattatagagggttaagtgcaggagtaaatgattcagacaaggactcctcaccctgtggccaggtagtcacaaggcggggatcctttaaaaaggtaagctctgcagcactttgagaggccgaggtgggcaatctcgaggtcaggagatccagaccatactggctaacgtggtgaaacctggtctctacttaaaaatacaaaaaaattagcggggcctagtggtaggtacctgtagtcccagctgctcaggaggctgaggcaggagaatggcgtgaacccaggaggcagagcttgcagtgagccgagatcgtgccactgcactccagcctgggtgacagagcaagactccatctcaaaaaaaaaaaaaaaaaaaaaaaaactgtgatcttgtaggtctaaggttgagtctgaggagctgtatttattataataagccccacctgttgaggatggatgctgctggtctgaagaccatactttgagtagcaaggggccagtatagacaataacagccatcggagttcaaaggagagaaatgaatatggtctggccttgagacctctctcaaacctaaccatgtcttctagtaatacgaatcctgtcttaatctgcttaggatacaccttaaacaaattaagtcatgatttcatacacaggtatatatcggatggagggtttggtttcagaccactgcaataaagcgagtcacacaaatattttggtttcctagtgcatgtaaagtcatgtttatattgtagtctactaagtgtgcaatagcattatgcctaacaacatgtagaaaacttctttattgtaaaaaaaaaaaaatgctagcaatagttgaggcttcagctaaggtctttgggaagtggttggtttctagtgagactgtactgtggaaaggcagcctgtgtagaggttataagcaccagctttagaatctgactgctagggtataaatcctgtctctaccacttatcagccatgtaatcttgggcaagttacttgacttctctgggcttcagtgtcattgatagattttttttaatccttatgccaatagcacattgtcttaatttagctttatattaaatcaagatttaatatagtgtgagtcctctaagttcattgtttttcaaggttttagttttttaaaaaacctattctaggacccttgtacttcaatataagtgtctggatcagtttgtcaatttctataaaaaagcttgttggaatttcgattaggattgcaatgaagcaatttgaggaggtttggtaccttaacaataattgagtttttcaatccataaacataatatctcttcttgtctttaatttttctatgtagtattttatagtttatttatttatttattttgtcagatggagtctcgccctgttgcccaggctggagtgcagtggcaccatctcggctcactgcaacctctgcctcccgggttcaagtgcttctcctgcctcagcctcctgagtagctgggattataggtgcgcaccaccatgcctggctaatttatttgtatctttagtagagatggggtttcaccatgtttgccaggctggtctggaactcctgaccttgtgatctgccggcctcagccccctaaagtgctgggattacaggcgtgagcgaccacacccggccattttatagtttttaatgtaaaggagctatacatctttttgttaaacttaagatcttaagtaccttatgttttttgatgctattataagtggcattaaaattgttttccaaaatattgctaccggtacctacaaattgattttcgtatatgatcttgtgtcttgcaaatattgttatactgaattctagtagggtttttattgattaggataataggattttgtaactgtagattaattaggatacacaatatcatctgtgagtagacagttttactacttattttccaatctttataccttttatttattcttgctttattgtactgctaggacctgcaggctaataatgaataaaaataaaaatccttgccttggtcttcatcataaagagaatgcattcagtatttcagcattaaatattttagcttacaggtgtttcatagttgccttttattagattgggaatttccattctattcttaatttgctgacagcatttatcatgaatggatgttggattttgttaaccagcaaatctacatctattgagatgattgtattttttttctgctttattctgctatatattctgctagatttttttgagacggagtcttgttctgtctcccaggctggagtgcagtggcaccatctcggttcactgcaacctctgcctcctgaattcaagtgattctcttgcctcagcctacctagtagctgggactacaggtgtgcaccaccatgcccagctaatttttgtatttttagtagagaaggagttttacaatgttggccaggctggtctcaaactcctgacctcaggtgatctgcctgccccagtctctcaaagtgctgggattacaggcatgagccaccacgcccagcctttattactatttttttttaagatggagcctctggtgtgtggtggcgcgatctccgttcactgcaacctctgactccctgattcaagcgattctcctgcctcagcctcctgagtagctgggattacaggtgcccaccaccacgcccagctaatttttgtatttttagtagagacaggtttcaccatgttggccaggatggtctcgatctcctgacctcgtgattcacccgccttggcctcccaaagtgctgggattaagggcgtgaaccatcgtgcccagctgtgcatggttgctttcatactagcatggcagaattttgtagttgcaacagagaccatatgaccatcaaagagtaaaacgcttactatctgaccctttatagaaggtttgctgaccccttatataatggaaaagaaattgagattggagaggtaaaattagctccaagttttcagaagcagacaaaactcattttgagtctttgctcagtttgttactagatagagctctctgacctttgctagaaattatttaaaaggaaagtgaatgtgaaaatgtccagcaaactggttggtacactttataaagagatttggggtttcggccaggtgtggtggctcacgcctgtaatctgagcaatttgagaggcttgaggcaggtggatcatgaggtcaggagattgagaccatcctggccaacatggtgaaaccccgtctctactaaaattacaaaaattagctgggtgtggtggcacacgcctgtaatcccagctactcgggaggctgaggcagaagaatcgcttgaacccaggaggtagaggttgcagtgagccgagatcacactactgcactccagcctgacatgccatgcaaccatttgatttcttattttgtttgctctggaggagttggattgaatgaggtcccttaaagggtcaaatagctcagatgtagatgttaaaggtatcccccactgttccatcagattggaaggtgatcctcaaatgacgcttgaattcaggaataaactttagccacacacacgtacatacacacatataaatatatgtatatatattttggggtacctattttcaatataaggactcttaagcatcaaacatatcctaaaataatcggtcttcagagacccctcccacacagatgcttttatttttcccaaaacaagcatgaattgacttagaggctggctcaaagatataacggcaccctccagcatggtgaatgcactcaagagggcattgtcccttaccacagcttccattccttgcacctggctccaacccctaggacatcagatacttggatgggtagatggatgaaccaccattctggatagtaattttcgtggttcccaagcagcttttttactctcagtggatgaaaaccaatacgggggaagagaagggaggcagaggtgttacttacctctgtataatagacatgtaggatcctcaactccagcccaggtagactcttattggggattaaatttgatctaacatgtgacgtctctggaacaggagctggtaaatggcagactccaatttcattaggggtcaaggagctagaataaagttacccttcatgttatctgtttccttgaattttcttagccctggacattaaattctgttctttaaaagtcgctcattgaggccgggtgcagtggctcacctctgtaatcccagcattttgggaggctgaggcgggctgatcatgaggtcaggagattgagaccatcctggctaatacagtgaaaccccgtctctactaaaaatacaaaaaatcagccgggcatggtggtgggcgcctgtagtcccagatcctcgggaggctggggcaggagagtgaatccgggaggtggagcttgcagtgagccgagatctcaccactgcattccagcctgggctacagagcgagactctgtctcaaaagaaaaaaaaaaaaaaaggtttctcattggaattgaaaatttcttcctatgacgtgtctgagaatatgaagtaatgaaaagtgggctgggtcagccttggcctgaagtgatgcttacatgaattaaccatctctggagggatactcgtgtcaaagtaggagtttattcatgcttgactctccagtgtgatgtctgggattgcttgcgccagctctgaggagggcgtgcttgtctttctttgtgaaataatagaatatggatgaatccgtttccccatgaaaccatttctgttgaactaaaatacaaaggaaaatcggtgaccttgaattaggcttgtttgcagtgttattagctttcaaaggccctttcatttccatttaatgattttcttctgaacaaactattgtaagaacctaatgcaatttttcaaaaccaacatcacaaacgtggttattattttgtagctaatttggttagaaaactatgaggccctatgtattaaaacgtcatgccatcacttctcagaatggcacttttaaaaactggattttagtcttctggataacgatttcttgaactactgttatcaagaataagtggtatttttcatgatctttcttgtctggagagttcgtgacaggaattttgtgcatgaaggatgcctgtgttgttgaatgtgttcttgcatccatcttgctcttactcagatgtctgaagctatacatgtcaacttactcattcaacatgtatttataaaagtgtccattataggctaggcacggtgctgttctgggggtcatcaatggaaaaaacagactataaaatccctgccctcctgtagctaacattcttttaaaatactgatggcagaattttaaaacactgatggcagaattggaaagaatgcccccgatacaagcaagaatgaaatacagtttttattttctgcatctaaaaatcacaataagtaacttacctcgtacttctaagagtttgaatttttttaacttggtaataattttagtaggcagggtgcagtgactcacgcctctaagcccagcactttgggaggctgaggcgggcagatcgcttgagcccaggagtttgagacaagcctggtcaacatggtcaaaccccatctctacaaaaaaataaaaaaattagccagacatagtggcatgtgcctatggtcccagctactcgagaggctgagatgggaggatcactgagccctgggaaggtcgaggctgtcatcatgccactgcacttcagcctgggcaacagagtgagaccctgtctcatactactactactactactactactactactactactactactactactgctactactactactaccaataataataataatttagttgctctgataaaaggccatgttactttacttatggctactatttgagtgcccactgtgtctcacaccctgtgctgagcgttcccatttaccccatttggcagatgaaaactacagcatgttctcaactcagtagagagacacactcttacacatggaatcttaaaaaggttttaattagtcacttacaccaagttctgtgatagttccacagtgactgaatccaaactgcgcagaattgagagtagtgggcaagagtcaacgatgggtttccagttctgggaacttgggagactggggtgaaacaggtcccctctttcctgcccacttactcctccaaacaccaacttgctggatgaaatattacatatgatcctcattgaaagagaaaaaacttggaaagagaacagaagggagaggaaaaagatgaaactgaaggggaagggagttgttcttaaccacaagagcaaaacaaaagccagagctccgtgtgagctgccatagtgtggtgtctgtagtttctgtatggccaggaagtgcccttggaagcaagtttcatgaacataaatgatcaaagccaactaaactggtcaattagtcaaacttggcttccttagaaaagaataggacctcaatttagccctatttgtcagctagaggagtcaatgcaattgaggggtaaggggttgacagtggtaataaatcattgggcttttttctcggctgtatctttgcctcataccttcgtcaagccaccctagaccctcctctagcagctccaagccccttttgtttgttgtcacttctatttaagcctttgccttaggtaccaattagtgaagtgattatcttaaagttgccattgtcaatgctttggagaacgccttgcattttgaccaagctggtgagggaattgttaagttaaagatgaactctgcatgattaaggtatcaaaacggcttgaagactgccattttaatgcacctttcacaaggctgtgcaactctatacttaaataagtggccagttttgtttttaagtgacgagccacatggagaaaatacttccaggatttcagttttgaaacaattgaaattctcctcctcttagagtgttagctcctgtgtgtgtgaaatacagctggtcacctctccctgtggtgctgactctccactcacggaccgggcaccatctgagatgtttgacagaacattctgaggaaatggaaatgatgaaatcacattgaattcaacagtagaatgataggccatttaatgcagccttaatcttgtggctcagttggtgtggtgtaatattaggcttgcattctaccttccaaatcccttgatagtataaactagcaaattaagacttaccctgaaaatgactgtgtgctacactacaagaaaggtagaatgctccaggagcagtacagatagaggtagtaacattttgccatctggcaaagccactagaccagatggattcattaatgacttctctaaagtatttaatcagacattactgaaacacatgactggcatatttaattatcctaaattaacaggacttctgccagatacaaccctcaatgcttgagtcatactccttgcttaaagagaggaggaaaaaaggatgactagctccagaaagctggatttcacatagacctctctcattagtgaaacttctcattagcaaattgttgtgttacagtcttaggcagtatttcttctttttcaaagaatgcactgtaagactagccatgctgatcaaattcttttatcagtagcaattatactggtgagaacctctgcgagttgataaatgtgacatagccatcagacaaccctgcccacttcctgcctgtggaagacttctaaaccaacagatgccttcttgtgtcagttaatcaatttatatttctccaggatcacttttgttttaatctttgtatttgtatcagaacaatggagacacaaaataacagaaagcattataatgtaaatttgcccctgctctagtctttcctatctgcaatctacttttcaaaggaacacttctaattttcaggactgttctctctggtggttacttccacatctcaaaacagtatggttaatggctatttcttattttctttagacatgttgacttccttttaacatacatgaggatgtagcttaggtataccattcttacatcacttttcttctcctccctgagggttattttattttttattcccttaacgtttacctttgtagctttaggttatattttcatacctttttatttttgggattgtcaactagaaacagtatgtcttggctcctaacatatgttgaaggtattagtgacttgagtattccactgaatgctccagagttctttcactcaatgtaatatttttgagattcatccatgctgtggatgtcactagttccatttctgtttatggctgagaacaattccattgcatgaatagatgataatctatccattcacttgttgtacgtgtgacctatttccgatttctggctcttttaaatctgtgaagacttgtatgcaagtctttgtttagacatttccttttggtttcccttggataaattctgaagagtggaattgctagatcataatggtacgcatatgtttataagcaactgccaaaagacttttcaaagtgatttatcattttacatttcctattagcaatatatatgcattccagttgccctgtgtctttagcaacacttggtattatcagtctttttaattttagttgtccttaacattgttcaagtcttccagcatattttaaattaagttgtgttcttattaaattataagcatttttatatattctgggtagaactttggtgattttgttgtttttttcttttcattctcctagtctgtgttttgcattttcattttcctaatagtgtctatcaaagaccagaagtttttatttttaaagtccaatttctcctttgtgtaatggttcatgcttgtttgttctctaagagaccattatctttcagaggtcacaaagattttcttatatttttttctatcaattacttggtttagctcttatactttttgagtttttttgcatatggtaaaagggaagagtaaggttcacttttttccatatggatacctagttgttccagcactgtctgttgaaaaacaatcctttcccctgatgagttatcttaacacttttgctggaaatgagttgatcatataaatgtgggtctctctatggattcaattctataccattgatttgtatgtctatccttatagcaatattctgtcttaattccttttaataaagactttaagcagaacttctacttttgttaacattttttctgacatatacatgtatgtatatacatatatatgtgtgtatgtatatatacatgtatgtatatatgtctatattttagatcttttctccttagggaggcatcttcagataactgatcttgtccattccaaatggtttttaccagtttaaatcacagagaatagtcttatttttaaattcaaggagagttcaccatagctctctatgtacatgagttgctcggacttagaatgtctgttcctggccgggcgcggtggctcacacttgtaatcccagcattttgggaggctgaggtcggtggatcacctgaggtcagatattcgagaccagcctggccaacagggcgaaaccctgtctctactaaaaatatagaaaatagctgggcgtggtagcacgtgcctgtaatcccaactactcgggatgctgaggcaggagaatcgcttgaacctgggaggcggaggttgcagtgagctgagatcacgcccttgcactccagcctgggcaacaagagtgactccgtctccaaaaaaaaaaaaaaaaaaaaaaaaaaaaaaaagaatgtccgtttctgggggtgaggggtaggtttcatgtgggtctatcacatggtggttaattaataacaataccacctatatagtgctaggttttaagtgctactgttttaatcactgctttaggatttattaagtactcatagtacctactttctttgaggtaggtactgttgttattcccattcttatggatgagaaactggggcacagagaggttgagtaatttgctgaaggtgatatatgagaaactgttctttgccagtaagtagaggagacaggtttcagtgatgcacttgtcacggaacaaacagctctccaggagaaaaaaaactatgcatacgcattaataaacttatacactttactgacataaataatatataatgcacaacttacaaataataaagtgtcatactttttattccacatggccaatcaattctgatagaatgcttttattgattttttttttcctctttttctaaactcctatatctgtggtcagtctatggttgcagtttaagcatgacttgacaaaatcaaatgaggaataaattcttgattaccatctggttcagcaaagaagttgttcacatcattggcaaatgattaaagttccaatatgtatatgttttacattttccttattaatgtaaataaagctatcagccaacatttgtgttggaactacacttgttggtcagtgatgtgagagaatattgaggacgttttctcaattttatatattcacaatgtaacagctacagagtgacacgcttttatgtttattctgcattatcaacattttatcctatctcttaagtctagacaatcaacaaaacaataaattaagccctgatttgtagcacttagtgatttccatgatgtaaatatacccactatggctgacttcaagccaccaatgtgacatcattgaaaatggagttgggaagaggtgtggagtaacacaccatctatggtatttctaccatatggataggatagcaataaataacctcacaactatagacaacagtgaaatgtagtaaaataattaccaagtgacgagctttcagtatgtattacctttgcttttaatataatttatgtaattgtaaatcaatataatacctaacagtggctgtgattaactggtttacaaagttgctaaaacttaatcagtttttggtggccagtctaagctggctccaatcatgccactgtatggctgtatttttaaccattcttttatacgaaggtattgctggaatatagtttcataccagtaagtatagcatacagttatggcaaggtattaagtttattttactaaatcacattctcattagatgcaccactcatcaagcttgttaaagtccagttttagggaccccccctgcttaactatggattatacgggttctgtggggttcacacaattcaggaaaatggcaatgaattttgctgttttgtccatgttgctgtcattcctgtttgtgctgcccaagcccaccaggaaggcagggccctctctgtggtgtcaagatcacagttgtggtggggtactgaagtgctaagcgcatctcttgggaccaggactggaacacagccatccccatctgaggttccactacctccaggccactgttcaaatcaggcctgcctttgccttttctgccttgcagatgaacatccactgaggttgggtcactcccccttcaatccccaaagcagcaacctccccttctgtcgtcagacaatgcaacctaattttgatgtgcctctgcctctgacatggaaaagctgctctcaaggttatcttcagggcagggagggagaaggctttcatgctttcctggtgagactttttttttttccaaaaacaaaacaaaaacaaaaaaaactaaacatataaattattactgagagaatcactgaagcagcctgggcaaaaatgaaatgaggcttaagaattgtgaacattttttaaatgctgcacttggaacaagtgctcataaaattttttgcctcaaggaatcaagaatgattaatattgatgagtgttttgttgttgttgttaaacttcataagcaaggctgtttccttccatgacccttttgattctcatcttttctttttcacaagatgtttggaaatcttcgtgatcttatctgacatcaggaagacatgcttttccctcctggcatgctagagaaacaaatcaatttcttctcccagataggttgatgaaagtccttctctgcagtgctttctattgctatggtaacagaagatgggatttcccaacagaactaggtttatatattaaaaaacagttctttcaaaacttgatcctttttttgttgccatatataaaatacaataaatggaataaactgagtaccaaaggaaaaacagtcacaccaaaactttttatgtaggtgtggaatgagactttcattgtcttgagactcgcaatgaaagggagtcaactgtaaaagttttaatattgtgacagtgctgtcgtagctaaaataacttgcaaaagttgcaagtcttcttagaaaagcaaagaattaaatatatggactctcaataggcagatagacttaaaatagagataagtagtgtccatacttccagtcataacatggtaaagaagatgacaagaagcccaaggtagaataagcattttgtgtgatggtggcactctccgcttctgtgacttgcgctatgggaggacacaatagttggccatttctcatgagatcttatcaaaagcccagggattcaggggacagggttctttgcatcacagtccctcaattatatgcaaagacctgaccttttaatctgctggttgactaacagcatggctggagggtgacttctgaggctcagagcactcagaaaggagcagagagcaattgtgaggtaggtagaaaaggatggacttggtttcatttggggaaaattcaaacataatacttccctgtcatttaaaatgcttctgaactaaaattccaaagatgtgtggaattttatttattaaataaatacttattaaataaatctgtaactccaccattattgataccttctattctcttgcaaatctagtgagtaaagttcgtgagcttttctccttttttgaggcttaacgtgcttttgaaatgacatgacaaatttaaaatagaagtaaatgccatttggctgtgccctggatgagacatggatgccatttggctgtgccctggatgatacatgtcactgctgaaaggggtggagtttctgggaagcctgatgggaaaggtaacaaatagtaaagtgaataaaggtggttctctgttcttgctattcttgacatggacatagataaatggtaacattatgagtcactctaagcaatcatgttacatcaagccagagaggtgatgtcacagactctggctcatgaaaggagaaaaagctcattttcttaatgtacccaaatggcaaaggaggactggagaaagggctgtaaagagatgatttaacaaacagtgtgaaggaacttctggcaagaaaaaaaaattgcaatgtgaactttttagtaaatgtggtaaatttatgggcttcaatatgaatgagaagaacaataaccagcataaaaatactttaaatccaaaatgtgaggtgttttggggtagcactgcttattgagtaactaaggctcgtaagttatttgaagacttgttgaaatctgtttattccattccccccaaccccgtcattcaaagaactgcaataaatcaggaattatggaattagaacaactgctcggagcagtgatttattatttgcttctggatgcttcagaatctcaagaatctaacaagtatctcaaggattttaaaatagaagctgtgatcacagcaaaatagtataatttatatctcttgaaagtgtttctggccttccaggggaaatatgctcattcttcattttctagtccctgggtagaacctcttgcctattgcagggggagaggcaatatggcagccaagatggttggcagcattcactccctcttcaagtattttgttaatgcctactctgctgtatgatgttccaggaactgtttagagtgatggaagacagcccctgccctcacggagcatacaatctagtcaatcctcttcttcctagcctttaggactccagatgtgatgctaacctgagcagtctccttggtttccccactaaaaattggatagttaggccatcttttcccaggatcaggctcataggcttcaaactttactgtagccaggctctgtgagttacaaaccttgttgcccgcacaaaatcttctgtcaactttaatgtgcccaagcttgtccttgagtctcaaacatactaagcatttccccctctgttctcacccccagtagctcttgactcttctttatcccctctacccatgtcttccctccctgtctctccctggtccctaactgaccaccttgcctctcctaacacccctcacagatctgtccttacccctgcatttcatcactgctaggattaccttcctaaattatggaactgtttatgctgtgtcctgctgaaaatagtcagtggtaccctaatttcctggcctggctaaggcagctttcaagagctgcccctgcctgcctgacccatctcattttctgccattctctgtaagactgaaactgtggaggacattgtcttttcacgtgaatcccctttgcaccttgtctttcatatgaactcgtgtcttccctaatgtcctgggcagctggtcactccatcctccatctttctccatcctccatctttctgtgttactgtgtatgtatattgacatatcgtgattatttctttacatgtctctttcctctgaaagtgggctccttcaaagatagcagtgtgatttctgtttatatgtctatggtactgtccctgacatatcataggtccacaagggcctgttgaataagtgaatgagctaaaatatactggtttatcaacagggttttcaaactgcttccatccactcagcttaatgagcaaacatggcatgccataatcttgcagttttctgggacatctaggtactttgaaataccaggtgtgtctcaacaaaattgagattgggagggtcctttcttattgataatctctcaccaactgaatgctgaagtgttctacaaccttaaaaagttaaaagcttatagcattcacctgttgtgaaaagcaacccttctatatgggctatctttttgtattacttgcttatgaagattcctgaagatatattttccagcaagcacttttcagatgtccaacatggatttaaagtacatatgttgtttttggaagccatattatattcacacaggcatgtttatgttggttatagatatataatgctgattacacaaaagacaaaatttgtattcagtgttcgctctgtaccgggcactctgctaagtactctagattgactatatcatctattttctgtattatctgtatttttagatgaggaaactgaggcaaaagatgaagtaatttgtccaaagaaccagagatactaagggcagccaacatgcaaatccagtgtctgatatcagaacatatactctcattaacaccatgccaaacactgaaaaaaaaaaaaagtctacttccatttactgtgttaagcagatactgaaaattggaatgggaaaatttgtatttgttgattgtataagcagaagtttacacaatgagctagtttgctatataggtaatgtgctcttgattcccaacgtctgttttttagaaagacacaacgcctatacacaatgaatttaaaacattagggtgattttttttttttaatctaggaaaaatacttctcaacggctactgactccttaaaataccagttggtatttgacgaagtttcatttttatcgaactacagagaaaaattgctatacaaaccacaattgtaatttgtagttctttggtgtcacagtgatctatgtaaaatggaaactttaacttaaaatttgtaatctatagcaacagacacagaaacagcacatgactctgggacccattcatgctttgaaatcctaatgaggatagtatctagtgcttctgcaagtatgtttaattccaagaagagaaccttcccctagtaacaacatttaaaaaaaaattaaagtcaaaagctaacttgaaaacaagtaatattttgaatatcaataattaaatttcacaacataaagcaattataaaactatacagacgattttaaattgaataattacaatcacaacagcacctaattttcaaggtaaccaatgggtaagaccaaatgagattgtcagactgtgctaagcctctctgctaaagtgaacatttcaattagtcaaatcaagtaattaattactttggggacagttcagactctttctcttgagatcaccttgttagataatttaaatgagaaacagatttggataaaaggtgatcagtgttttcttcagttggaagatgtgaaaagaaaccttttctctttcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacaggtgtgtatctttttttagttgttttatttaatgacttctcacaactcacttaaaactataataggaatagccagtagattcaaagtccatcaacccttgctggttcttctggcacagcctcctagaatttttcacctgttttttcccctttaaagctatggcactaacaccaaactctggacaggccttggtttttgttcccctagtcccaccatctggttaaaaagcatccataaaagaagtcatgaattcatggtgatcaggttcaccatagcccagtaattctactttgttgtctgttgttagcttcctatttggagtaagggctagaccaagccttattcatagacgtcaagccctgagcatgtctgtagtacctcttgctttcaaaagatgacatcacctcctaataatccactgagaagattatccttgactctttaccccttgatgtcacttttagctgcttctacctgtcctctcccaattcagtctatcatcaattcctgggtattcatgtttctttacagtaactgacatcctctcctttccattcttcctgccactgtcctttaagtgctaataagtcagtgtcatgtctgacttagttgaatctcttagtctcctcacaggcaatttcttgctaatgcatttcatcaactgaaaacggtgtgaaagcattgtttaaaaccaataagagcttggagtactcaatgaataaagtccacactttgtaggtgggcattctattttagccaacttttctagacttttatccgttgtgccctcatagtcgaattggacaaatctgcaagactcctatagcagaccttgcatgtttgtacctctgggccctgcctcagtctgtcctgtccacctgaagtgtcctgctcacccttttgcccattgaagtgattcagtctccaaaggttttcacaaagccttgccaatccctcccaacaacattttctcttcttcctttgacttacagcaacactgggcagaaaagataggttgatacgttctagaaaagaaagtaaaaacggaggggtcattcctggctccggctgcattcatctcctccctaaggcggggcctcttctcctcatctccccaaccgcctccgtttcctgtgccacccttcctctgtctctctcaccctgcgtgtttctgcctgttaattccttcaatctaatttttgacaagtttcagagttaattctgtaagttggtgccatgcaaagatctgtgaaattattcatagaggcttaactgaaagtctgtgggaaattcagtggattataggagttgacctgggttgagtcacttttgaaaaacaattagcatttacttgctgttttctgctattttaagagagcatcgatcactagtcatttttctttctagaactagatttattacatatgtagacccctggaatatatgttctttattttactcctttgtaatctcatccagttagtcagtttaatgcatgcattcccttttatggctacataaagagataatagctggatgctagtatttgttcaggcttgcagttatattgacttcctgaataaactgaagtgaatcagaatccatacacatgtacaagtataaatgtatgcttatgtctgtactggtatgcaccttctctaatcggattttgttattcaagcaagcattctttatcaatttgttctgaagtgtcacaagaaaatgtaatgcagcagaggaaaatccagctttaaaaatccagctttaacttcatttttgtccatgttaatttatgttagaatcctagctattctcctttaggtttcattttgaaggatggtgggtgggggtggattgcatggtacttaactgtcaggtgagagaaataacctcttgtatgttagccatggtggatttcctggcttgttgatggctatttcttcaggtcctccttactccctggacagagttcactggaatcgaatgatatttagaaatgacaaatggtccatcacctcacaatagacaaaaggcaataaaaatgcttttcaggtagctatgggaactgtcactacagatgaacaaaataggtttctttcagctttttctccatcaggaaatgtgggttttacttcagtgcccctatttgtgttcactgctttttttctcttgaataagctgaatggaattcacccattcagattttcttatgaataaaaatacaaccacatcttgtttccattgctgaaaccctcagttaaaaaattatagcaaagaaatttcttaaggacacattaaaaaaccctcaacgatgtgtgttatattaaaaattcctaatggaagccatctttagtgaagaaagctgaagaatccctgcataacagcacatgtatacatttaaccatatgtggctgtctgtttcatccacactgtgagtgtgcatatacacagacacactctcgaatgtactcagtactcacacactcttacacttggggaataccatatttttaaaacccctttaatttacatacttcacttgacccatacaacaatccaataatgcagaaggaatgattattttttatacccattgtacaaatgagaaaagtgagatttaaggaggttaattttgcaaggtgttatgtctggctacttaaaagcaaaaagaaaagccaaatctacttatagttcagatttcttacataatactttctccttataagtgatatcctgcaagaaactctgattttggtatgactgttgcctgtttttcacacttttggttttgtatataatcatgtgggttgcattttattcttactttaaggacaggttctgacctgaacccagggaatttaggctgggaggtgaagtaccagattacttctacttagattatattatcttgtagtcaccttaaatgtttgtgaaattatagaaaactaaaaattaatgttcatttattctattcgtcaaacccttaaattttagcagttggaagcttttagactatagaattctgggttctattaaatctcacattaagattttacctaaaaattttaagttaaaaattccaaatgctgctatcaagttctgtttctgtagtttctattgacgtttcagagatctcctgagagtttatatgtatgtttcttacacttaaaaaggataaaggagctgtagctcttaggttcttgaaatttcagcatatactaatggaagtcatcatctattgtgttatttttagtttggggtttaagatgggttttgagaaatcggtttgttataagaaattcaatgcctaacccatagtaaatagtaactatttcttaacgtgtcagtaagtcttcccatcacttttaggtactaaattattgttcttattcttagcgtttagcctctgtggggttggatgccaaaaacacagtctgcatttgggactggaggaagggaaaacttctggcgtcagccaccggccattctgacagggtaagaacttgttggatcaagctatgcagatttcagaacttggggggacttgtgatatcgcgtctcagacttctaatgtttttaacagtaaatatttcagtatacattttttcctattaaacttataatcatcctcttttttcatgattaatagctaactgtgttaatgtgcttctggtgatcaagtactttatatgaattgttagtgcttttcataggcaaagcaaatttttgatgctggcattttactttatgaaatcaaaatggaattgaatttgaaattatgtgtagtttagatgtattcatttagaaatggaaatagttgttagaaaatagtcacaaaatatgattacaagggtatgcattttaattttgaatgagtgtaatgacaacttcgtgattctttgttgtatttgagaacatagaatgtgacctgcttactcctgttgaagtcagtgtgatcaaaaatgataattccatgtagtcttaggggatgaagggggtatatacatataactggtcagaaatctaatttgccagtgtcttgcataattaaaataatttgactcctttattatcttggtttctctaaacaatgaatttgcatgactgtcttacttgaattcctagttgttttgtatttctgcacaatataagtgttaatgtagaataggcatttccagtcttttggcttccctgggccacattggaagaattgtcttgggccacacataaacaccaacactaatgatagctgatgagctaaaaataaaataatctcataatatcttaagaacgtttacaaatttgtgttgggccgcattcacagccatcctgggctgtgggttggacaagcttcatgtagaatgaggctctaattaaacatgaaattcactgtctcttgcttagaaggaactcttaaaaaaaaaaaagtatgaatggcacattgatctatggaggtttgtagttgtaaggagaccccacagatgttgcaaattctactccaggatcaagtcttcagaaagctcaggagtgaccaacaatagaacctcagtactggaagaggcctggtacccctctcgtccagtagttcccaatcctggctacagatagaatcctctggggagacttcacggcatatatatacactcatacataatattttatctgagttactctgcatttactgcttctatttctgagtcattttatatagtctgacctgaactagtatactgtctgtcagaattttgggccttatcaccttggaaaaagtagaaaactaaagttacaaacagtttaaaccagtaaaatctccttacttagaaaaatagcctaatgtaatcactttggcttgtatagaaagagcttttattgttaaattattactgttaaactaaatttggcctcagctgccctccatatggtaagtctctacaaaatcaactgcaacctagcttgctaagtgaccaaactgaaaatttaggggtatacttccgtaacaaatagctgagtggcagccagcttcagccaatggcaggctgccatctattcagaccatgcccaaataaagcaaattcggtgctgaaactaggaaagctgttcctgtacctcagttcattttccccaggatacatatgcctgcccagttgcagagcagagctctctgaacctcttctggttctgagggctgcccaatttgcaaacagttgtttgctcaattcaactctgttaaaactttagataaattgaacacctctggatatcatgtgacttgcctgtatgtttcagtgactgtgcatgtgctattgctgtgctaccgcttgccagtaagggtgaaatgtaaaaagtataataggactatagtgatgagtctgtaatcttaggatgttttaatgaaatgctttatttggaacactgttctcccagaccccataatctgtgtcacacataattttgctctttattactgataccagtatgaattattgactgcttatgattaacttcaagattatcctcaagattattttagtggcactaaaatacttaatccattacatttatataatgaatgttttataccctgcaaaatgactttatataccttatcttcattgaccttaacaaaacttgaggtggtattatccacgtagagaagatgaggttaaggttagagatgctcagacttgcctgagcttgaatggctgaaatggatacttggaccaagtactttttcttcagtgatctttctggggaccataattgctcctttatatgtgatgaaaagttagtggtctaggttatttctctggtctagactttgtccctgacaagtagtccttccctttctatcagtgtgtcatggaatgcgttccatggatctacctccatcagaatctcctggagtctctttaaagtgttgggtatctgggcccaattccagacccactaaatgagagcatctcagatgggccctggaaatacctgttttaagcaattgctatgggcaatttgattctcaggattgaccttttccttcttgtctctggattggaaatagaactacgtgcaaactgtctggtagctcttgttaaagaatgacaaataggccgggcacggtggctcatgcctgtaatcccagcactttgagaggccaaggcaggtggatcacgaggtcacaagattgagaccagcctgaccaacatggtgaaaccccgtctctactaaaaatagaaaaattaactgggcgtggtggcacgcgcctgtagtcccagctactcgggaggctgaggcaggagaattgcttgaacctgggaagcggagttgcagtgagccgagatcacgccactgcactccagcctggtgacggagcgagactgtctcagaaaaaaaaaaaaaaaaagacaaatagtagttgcagatatattttcagttcattggataattgaaaatacaatagtatgttgggtcagattaaaatgatagcctgagggactatttaagttagtgacagataaatccctctgccttacgtttaggaatattaacttctgtgattactagagactgttggccgcattaaattgtagttaactattgaatgttttcctagctaagaagcattttataattctttaaatttctattgaaaagctatctccaaagtgttagcactgtggagtgctattgaaaaatttgatcaaaaatttatcctaaattgtccatttgtttatctcaaatggacaaaattaaaaatatgacaccagtttgttctaaataattatggtaagttctctctctactcaggccttaaggtaagtagatatgaggtgataacgtgtgtgttagttcctgactcattccaagccaaatcttccatttttattctgtgcaggtaacattgtgttctaaatgttatagtagagtcttggcaattggactagtattgggaaaaggcaaaaatataccaaatgatcaacatggcaacttttaatgttttgaacagatttttgatatttcctgggatccatatcagccaaacagagtggttagctgtggagtaaaacacataaaggtaaagctttttgttttttaattttggtaccttgagtgcaaataattttaggtgtttgtatagataatttgatgttgagagactgctagactttacattttttttcttcaatatagagccctcttacctgtttctctgctcctgaagcaaactaacatcagctgatggggctctctcttagaaatgcaaagtaatgacaatcaagtgaagtgctccgcaggcagctgaaaaggaaattttatgttaattaaatatcgaactgaagactcataatacttgtgggattgcatgttttaaaacagtgcttattttaatgttgtgaagtaagtttttccattataatgaatatttacatatttgcatgtcaacactttgacatgttatgttcccttaaaagaaaggtgtcaagttgtgctctacatggaaatagaggaattcacagtacaaacctatctggaccattggtttttaaacgccccaatcttcctctagactacactctcatctgggtagacctacatttgcttcttactattttgttcacaagtaacaaaattaactgcatcaacatgctttgctctgacatagcaaaaatttctcctgacccctgggatatagcccaggatcttctttctctataggatcgtaaataatgtaagttaaagtccataaacaagagtataaggattactttcttgaatagagcatgcatggattctgtacaaaaatggtacatttctgtatgaatgaagattttcctctaaccaacccctcctattttgcagttcttttagtctagtttttcacgatccttcccattagtcttacttggttagaaggggacagaggataaaatactcaaataagtataagaaatatggaagacttacctaaagaatgttacaaaactctgcagaagaatgtaaaacaatacttgaacaaatggagtgacaatgttgattctggacacgtctaaaatttacaaatgtatcatttatctccaaatttatatttggtagaaatgcagttaaaatccctattacttttgtttttacctgacagaatttccctttaaattatcctaaattaatccggaagcattaaataatgacaataactatgaactttgggataaagaatcatgaagaggatatatgtaccactatttactaaagcataatagaatttaatttaaatgatacaagacttggatacaaagaaataaaaaaagctgaaaaatagaccttaatatgtatgacaacttagagtataatagcatctctaactggcaggcacaaatttatcaattttttagaaaaagtcaatacttcatactatacactaaaacaaagtctatatgaattaaagaggtaagtttcaaaaactataaaataactagaggaatatataggcaaatatttaactgctcaaattggagaaagatttttttaaaatgtaaaagcaaagaaatcgtaaggaataatactgatgcaactgtagaaatattaaaatattctgtataattccttttttccacaaaaagagggaaaccgcaaactagcaaaagtataagcaacacacaaaatagatactgggttgttctcaaaatgcaaagatctcttgcaaatccgtagaatggacaaagaacatagaaaactgacaaatagaaacactgttggccaatagacttatgaaaatgttaaaatctaattaaggaacacaaattttaaaataacagcattttaaatctatcaaatttatgattgaaagtaccgtatcttggcaaggattcagtgaatgaccactctcaaaccttgctggtagagaggggtaagctgataatggtctttcagccaagaaatttggaaatatttatccttagaaatgtcaattctctttgatccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaatttaaaaatggagaacaaaaattttagaggttccactactcaaaagtgtaacatattccatcaacactttagggcttcataaacatttaataatcctgtaccaagccctgatgtgtatatttttaatctaggaaaacatcagctgaaatctaggtagtttgctttattagcagcagctggaggctccttctgtgcttggtacagcatacctgaaagaccaaaaactcattcagtttaatatttgagtttgtactaggtgaaagaagaaaaacagacgccactttcaatttgcttgaagtttagccattaaaacattaagacagaatgttttggaagaaaggtaaaaatcaaagccctctatcgataaagatgacatcccagctggctagaagcatgttgtcaggatggagatgctgcttaggctgagcctcagtgggtgggtgagtttggtaggaagggtcgggaggcagaactaggcgaggggttgcacttctgtcaggagttaagagaggcattggtcacccatggaagtgtgagactggggagctgggtgggtccttggctcatgatatgttccaagattaccaatgttttcatcaccaaagaacctattccatagttttttttagggaacaaatattttgaaagatggcggccacaaaataaactagccaataaatcacgggttccttagcaatgttttattagtcaaagatgttatctgccaacgtgagtttctgatcagactaaaatatgaaaattgtttcagccatgagtaaaaaaaacatgtgagttcataatgatcctgatttctgttaggctgtggtgggtttctggaaatctgggaccctatcctgggagccatcatccatcctgtactcagtggtgaagaaacccaggaccctagggggttaggtgggaatctgactttgatttgtgattgtttccctctgcttgactctgggcaaccatttaatctccctgaggctgaattaatattcattcattcattctctctctctctctctctctctctctttctgtctctctctctctctctcagagagagatcactacctcctaaattaaagataattacattaaagagtatggaacccagtaggggcacaataatgttaatttcgttccccatttcctagggtcacaaaaatgatggcacaggtgagatttaagctcagcctctgactcctatagagctctttacactgagaaatttctttagtgaactaccttgccttaactttttattgggttctaactagatttgctgcttaattgatagaattctcctgattccttcctatctctttctgtccttggttaactctaacttttaaatcggtaaattctaaaagcagaaaagcagagacaaaattctgaaactttatttgaaacaagagctacttatcctgtttaaatttaattgtcttagcagacttggacattttttctaagcaaatacaagcatttttacctcaaagaatctggaatgtctacccagcaatactttattaattttgcttagaaatataatacatttaagcggacttcaaaaaattatttttgctgtctgtattctctatatccaattaccaggatttctccacttttttttccccagaaaacctaccttaacattgaatgattccagtcataaattgagtgcaaaatctttgtactcaaagaaaatactttcatctgaaatttgtatagctagggtgaaatcctttttggctttgtaaatcccctatgttttggcaaataggaaaattgcaattatctgaaacgaatgcttgaaaaacagtaacagttgagcatcggctgcttcactggttttatagcaaatgagcctaccgggtttgtggatactgttgagccgtctctagtcagagacagaagggacttcagggactacctagggctagatgaactcaaggtacctgccagctctaacaaaatttgcattacagtctgtgggtagagactgcagaagataaacaaggtctcctcatttgatgtgaatttaatgatgtgttgctaccctaaactgccactgttttccaagtaggaaatgcttctcaaaaagagataatatttcaggtatttgccattttctgcagaaaataacatacattttagggaatcatttgactctttggaatgttttcatgtgggccttataccatctgacctggtgacttgtcaataaacttttatgtagatcaagtctgaagataatgggttctattttttgtgactgtctgtctggaaatattcagataactcagacggggggtgtatatccaaagttaaaggacaaaataattattttaatcttcatgcatgaggaggtgtaaagagaaagggaactgtctgccttaagcattgctatgaacagcaagttctttggcatgttggtgcaaccagtaatcatttatgtctaatagtttgttcaggttcatagtaacagcttaaatgttttccaaagcttatacctaactagctttttcctagatctctttattctttattaaaaaaaactttattacaggtgtgtgctaccactccaggctaattatttttgtagagatggggttttgccatgttgcccaggatggtctctaactcctgggctcaagtgatctctctgccttggcttcccaaagtgctggtattacaggcatgagccactgcacctggctgctttattatttcaacatatacttcaacaccttttcattaataatacccaaagaaatgagttaccagagctgatacctttttctgagaagagaatccgatttggtccttcattgtgtatctgcccttcattcttgccaaggcatccctctattccttaaccccctgccacgcacacacataggacagccccccacccccagctgcctgaatcctggccaccttgggggtatagccatcccagaactgtttcctctagtacccaactactctgagaggaccatggtttttcctctcctacaggtgtaaaatagtacaatgttactgatttactcccacatgcctgccatgtggcttcatctcatcctgcttctctgaatccagatgcagtttcttcctcactgctgatccaagtcctactcttgttcattctgtttaattcaacttagttctctacctttgaatttcctgccacccgggcacagtctgaatatgctaccttaaaattatctcattgtttcatttgcctctgcattgattcagagttgtcaaagcaaagacaaagatttcagtattttttctaaccccattgaacccttatcttcagtgagctacttctgtttgctttccctcccctccagatggagatgaccatcctgtctaccttagcctattaaaggttttgataggatcaaataacttagcatatgcaaatagcccttataacctgagggggggctatatcaagggcagtgaggttattctagttgatacatgaaaactatgttaaggttttgagaggccaagtggggcagatcacctgaggtcaggagtttaagaccagcctggccaacatggtgaaaccccatctctactaaaaatacacaaaactagctgggtgcggaggcacatgcctgtagtcccagctactcaggaggctgaggcaggagaatcgcttgaacccaggaggcagaggttgcagtgagccaagatcgggccactgcactccaccctgggcagcagagtgagactctgtccccacctgcccccccaaaaaaactatgtcaatacaaaatattttgtgtctgtttaaccataggagtgtccttactgccttgtataaaattgctgaagctttgtgtatggtcttctacacaatggacacattttatgcaactaaaactgaaaagccgagtcaattatttgggtatatggaaatataactcatatttatgaaacgtttctaagtaacatttctacaatgaagatttataacacttaaagttagaaattatttccaaatatatgtacactaaaaatacctagatatagccgagtgcagtggctcacacctgtaattctagcactttgggaggccgaggagggcagattacttgaggccaggagttcgagaccagcctggccaacatggagaaaccctgtctctactacaaatacaaaaattagctgagcttggtggtgcactcctataatctcagctactcaggaggctgatacacaagaatcacttgaccctgggaggtagaggttgcagtgagctgagatggcgccattgcattccagaagttacagactatcacaattttcctttttatacttatctgtgtttctaaacctttctacaataaacctatactacttttataacttgataaaaaactaagcaaaacatgatttgtccacttgattccaactctgagaacattatcttctattaaatcaccattaaacaatgagcaaagctttgaaattttggaactttgaaagttttaaaagtgttgttataggcttttcttatgttcctggtagttagctaaaatgcttttgtgttacatgttgttatgttacagcaaagcaaattaacttatttgtgcctagcttggatagagcacattatgtgaaatgcactgaagtataaataaacaccaatgcaatacatccgaatactctatcttggagatctattttatcacttacattgtagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgtaagtattaccttgtggaaatctgtgggtgacctaccaaataaggtaagaccacgaatccctccctgtatgtttcccttcttgctttagaatcagagaaccctgctgaacactccctactcatgataatttcccatattacatttgctcacctaaaggaaaatatatttcaaaagcatacaatgtaattagccctcaccttaactattaattgcttgatttatgtcatccacagtagtttgacagaacactagaactagctcatcagattcatcttataggcacttctcaaactttaatgtgcccatgagtttctggggaatcatgttaaaatgcagattctggctccataggtctgcgatgaagtcgccacagctcatcagtgacccatagtttgaacaggaaaggtgtagataacgattgctcttgtattggttggtaagatagattttcctcattctttatgttgaggtgccagggtgtcacctccacaccagtgtcatgagctcttaaggtacaatcagaaaccattgataactacatatcttctgatggtctgctcagtaagaacaaggagaaacttcttaccactctgctctcttttttgacacacatgaaaatgactacattgttgtatctacaaatgataaaattgtccctataaatgggaagatgatgtaaaaggcaaagcctatcatagtgaatggaaattgggtaaagatgttattggaaatggtaagcctttagcttattgcctccaaattgattccctatacccttaatatgaagaaaagtttaagcaactcttagagctatgacatttcagatctttcactatatgttgcaggtgaattttcttggcttcactaattatgaaacagctcttaaaataataggtcagtatttgtcctcattcacaaaagcagctgtcttagtaacctaatttctttttatactggatcttatgtcaacattatattcttgcagcacttttgaacaaaccaaataaagtattttcctgtggaggagcatcttgaaattcctaaaactatttcccatgtgaaaatcttcaaacgatgcttaacaagcgaacacaagtgctatttacattttcatttaggttcaagtgatacctttgtgagctcactgaggtacattttgggcacttttgtgcctatgaaactgttcatgttcctagcctcttatctctacttaattattttaggcagcaacttccatgaaacacctccatagttgtcttttctctctaagggccacttatcacataaaataatttgattcccatatctgcattaattatatttttgaatttttttaaactgtaatctttttagtagtggtaaaagagcacttgaactagtttgcttttattattatgattttttaaatgtagctgagatgaacagtgttataaatggctacttggtctattgtcagcatttcaatagagaacaaaggggttttatttttgtttttgacttgctatgtttttaaatcaacattcaactgtatctattcattatacttaggatggttgcaccattgagtattacctgttttaatcaacaggctggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctggatgtgaaatataatgtgaagttctgtattcatatttgtttctctgtaccccattttaaaaaggcagtttatataaatatattgaatacaagcaaaagtatgttaaaagtaaatggatgtcctttttcctaattcgcacaaatgcatctgcatgaaccagcaatgctgcagccaaaataagcattctgatgaagttgctgaggtttcttaggagatgggattgtcagtgacaaaactgagacgttctagacaagttggttaccattaaagtgaatgtacccagcctctgaaaacaaacaaatgagaggagaaatgagacaaattttgttttaaatagctttaaagtagtagataattatagtagtagggattaagagcatgggctcagtcatgtggggtgggttcaaactctttttacctatgagagagttaagaaattgaacggcagtctcaaatttcggggcatctgtttcctcatctataaaatggagataatactagcaccagcctcccatagttgtatgaggattaaatatacttagaaaatgctcaggatgaggactaaatatacttgcaaagcgcacttagcactcaaactgttagctattctcaccatatatagagtgtatatatcagaatacaatacatcttttaaaattctcatggtaggcctgttaccttttggcagacaaagaatttacagccgagaaagattaaagtggaaaatgtaaataggtaagacaagaggaagtcatagcactgttaatacgctaagcacaggttgggaggttctgttcactccccacaggtgggccacagaccctgcgccaagggaggggtacatggtactgtgagccatgggggtccacaggatgaaaacttacccatcgttgttgtgaaggggaatctttttcagtgccgagatgagggagaaatttcctgagcatcttttagagaagaccctgtgacatagggctcaaagtcctcaacaggcctgaaacgagttgtttctcctgggctgttcctcatgaagcccccgctgtgtgacctgatggcgatgctgccacagaggttgttccataggccagatcatgtggcagtgcgcggtgctctctgccggccttaggtagatttcaaaggactgggagaaaacagcctagacggcatatccttcaggccatccttaaatagtgttgtttgcagcaaaactttgccaacagttgagcaacagggaaatgagctggatattgtacttcctgtttatacctggatgccagctgctttatgtatctgtgaaatacaaaaatgtgcatctaagtcaactaatccaggattggactcttgtcttctcacggaggctcaggatgctggtgtgcatacgtttctgaatactaggcacagagtttggcataggaagttgtggaatttggtgtctacctcaatgtagggacaaggagatcgaaggccttaagttctctgccatagagtgtgggccagggaaacttgatccggaaaaaacatgccaaacagatataagcttgcaagtacccgtaagagcaattttttttaagtacagtagccaaaaatgtttggtcctgaaccatgaaacttcttggtatatctttcaaggtaaaccagaaaccaaaacatgtacttagagagcagagtcaacttgccagatgggattagtgaccataaactgcctaaacgttggggagtaccaaccaggattcatgactctttttggcagttactccatttaactaatccaaaaattgtatcacataattaaggcataaattttaaagcatggggatcagctaagaagccattggtttacgctgctatacttttctgcccaatactgagtccttgagcctggctctcctgggagagttcagggaccagttctgaatgaggatctgtgtaaccaggtgtggtactgatcacatcagccccacagccaactcccatctacagagttaggacagtcagcgacgccctccgttatacatcagtctcagattcccgccccatccttaccaagatcaaagcacatctggctggtacacggtggacactgggaacccgaaacaagcctgcacctcataggatgtgcctgccctgtggtgcctgggcttggcgttgaccagggattggtgtgcatcttagatggcttactgataaggcggtagcctgcattttgtagggagaaacagattgtgcttttaaaggatggtatagatcatgttccagtttgagtcccagggagtcggagagggcacaggggctgggatggagctcctgggagagtggagatggcactgcttagcatgcagccccacagtgtggatgctgtggatgatgttaattttagaattgctgctgacgaccagtactcttaattgcttagtattttactttaaactgattaatatatctttttaaaactttgctttaaactaatatttgtgacatgagtttaatatgctggggtttaatttttgcccttggagcacccacctaaaattatcctctccccctggcttgggcaacattgtcacaaaaggccactgtgtatcatcaagcatcaaaagagatgccttcattccagtcctcagtgaaaaaacaatgtacatgtagcatcaaaagaagaaaggctcctggtttgaattactggtaacaactaaagtctggcccacccattgcttccaacttagggagttcttgagcctgcatggacagggtcatgtggggaaacttgctctgaatccctctctaaggtgctctgttgcgctcagccaggccttggtgccattattgcactgaagcaaggaaggaggatgttgagttccagagccaccttccatagctccgaacagggagagactctcagaaccggccctcctgtggtcttggaggctggctgcctgggccatcctgtgatggggcagcctctccaaggcaagtggaggtgtgccccaaatccaaagtgaggtagaagacccaacacaagtgtaggaattaaaatacataggatttgaggagataaaagtaatcaagatgtaaatagctttctggcgtagctcccccttcagccaggcaataccatacccttggttgtttcaacattagcaaagagctgagcaaataaaagggaaggaaagagggtgggaaaagagcaaaagaaagcagagtggacagaagatggtcaggtgtcctgtcctccccacccccccgccaacccctcatcccttccctcaaagaaggcttggccttctgctccacctctctttgcctcaaacaaaccaagtatattcgaaaggaacagattcaggcagagcagtgttagacttccttgccctcagtttggacatgaagcttccttgttctcagtttggacatgacagttttatttttataagaactatcttgatataaatgagctttcttctgtatttttgctatttgtgaaacagcgacactcgaattcatttcaatggaaatgtagcgatttctcatcttactcaaacagccaaatagttttctaaacaaatttagcaagagaattaatcatggccacggcccagttcccatgacatggtatgggtacttttctatgttctataaatttaaaagtattagcaaaaattaagaaattgctgcttactagtgtttaggaatctgagggtatttataaagatcacacttagtgtgccacctgtaaagacttctgttgctcctcctgtagacatctataagatttacaaaatgaatctgacaatttccaagttgtttaatggaaatctttgcaagattggcatacatttgcatcttctaataactattaactgttagccatcaagaaagaagttttaaaatgaactaagatggatactaagctcagaaaaaaatgatatggctttgtaataaagtgacattattaattcttttacatctttgtagtagcttgagctaattaggacacttgacttacagtaaaaacaattaaccccactttaggttaagcgtgaatgattggagatgggtcacattcacatcaagaattggttagtgtcagatctgattctcagggctccctcccttctccccaagggttagtcaaagaaaatgtcactcacatgatgaggagggccatccctcagtgaaagggaattgtagagttttatttgcaccggtgacttgtgcatcttttgtgagttattgcatttttgctgactgggtgttcaaacaagtttctgtagcaacaacaacacaagatgatataaaccaacaacctaattcacccaggatccttcatctgcaattctcaaagccaaaaggttcagaataccagaagattttctaaataactaattcggcagcaaaacttgacctgatatgaggctactgggtgtctttatatattttgttatagaaatatttaatttcaagatgctgcctcagtttctgctggatatattacaagtccaaaatccacatttttctgaattccaaaatgcatctggcaccaaaggatttcagctgtatggggtggttgtcctccaatatacatcttagtgaatataaaattctggaattttcaggctgggagacaccctggatgtaaggcggcggtggcggggcatggggagaactccctcacttcatggatggtacaatgaggcccagggtcattagcatcaagctaattgtaaactgaagtcactcactcatacctcacaccaaacttcacaacagtgcatgctgagtctgatcacttttaaaacacatttatgatctgggtaaaataatgaagcttgagtaacttatagtggtggcaagaaaagccaaaattcttaaagtccatcaaccaaaatgaattacttctaggataataaaacactttgggttaatggttataaatgattctgtctaaaggaatacagtaattattcacacagtataagatgtattatttacttatttgtccactcagtaaacatttattaaacatccaagtgccagatacgtgcctaggaactgaataggaagtcctgaaaagtatacttcagtcaagattatattttaggtgtgagtggaggtcgggggagttctgtgggttttaactaccaacacatatttattgagttgttgctgtgtctaatggactataaactccgcatccagaaagaacctgcattaggtgaatcactgagcaagaattagaggccaaagttccaggacatgagatgccctgcttagacttgtcactatctccactgaaccttctctggtcaggccaccaccatcttttacatagaatattgcagttgctttgtaagttgcattcctgcttcgaccaccatcctctgcacagcagctagagggattatttgaactttatgtgagccagatcacataattgctttcctcaaaaccctgcaatgattcatcttacccacagtcaaagtccttatggcagccaccaccctccgcattgcgctgcttcgccctggctgctccttcccctcgctgcttctccctctgcctgtgacactcttgcctagaatctgcatgactacttccctcctctccttcaaacctttgctcaaataaagcctatgctgatgatctcttctagaattgcaactcattctgcctctaccactccaagtattccaaatccccttctcccgggtttacctttcaccttgtaacatacagtataatttctgtgttatgttcttggctattgtctgtttccacaaaggtagggatctttgttcactgatgcctcccacccacttaggacgtgcctagtgtgtgctggagtcctggaagtagctgtcaggtgaatgaaaagtgtcataggactggagggtggagccttgtggaggagcgcaagtgatgaggatgcagaaggaggaacagataacttggtttctttgtgtcaacctgtgacatgcaagcttgcactccaagggccaactacaggaggtcttagaggtttaggcaggcatgtggcataatcggatctccacttagttctcctgccccagagcagagagcagactggggtaggataggatcagaggtaggagcccaggtggttgttccagagtgttcatgcttattactgtttttactcctctgagtactgcgatggtcagatagtctagcagctctcaaccaggagtgattttttggacatttggcagtgtctggagacatttttgattgtcgcaactgcagagttgcgactggcatctatggatagaggccagggaagctgctaaaagtattacagtggacaggagagccaccacaacaaagaattacccagccccaaatgttgatagtgttgttgttaagatcccttgcagagaacgtccaaaagaccaactctcaaacctgagaacacccttgtttacgatagaagcaaaataagcacatcctattctccagtcccgcgggcggctccattacttacctcttgactccttgcctctgtcaccgctctccctgtgtgcccaccatttttctctgggcttgcccttcagcctcactgttctgctgagaaggtagaagaacactgcagaggcccgagcctcaggagctggagacagatttgcagccaggagatgtggtgtcactgtgtgcgcaagttccgtgtgtgacatggtgtcagagggctgctggcctggcttgtagtaattcctctgtaaataactctccttagccagccttatgtaaaagctagcctgggtgggtttcctccctgggtgggaggccatgggcttggctatgtgttctcatcttctgatatctcactaggctttgtgtatctttcacagttcccgtggctgtagaattttggatcctgcggagtgggttttgaaatgagcagagattttgtaaaaagaaatctttcctatgaattctgctggagattctcaggcagggagcctttgtgaacaggagcagcaggtcataggcagtccacgcttaggatgacctgcagccccagccctgcgactctcccagctcagggtcagtgctgaatgcccactctgtggtggcctttgtggtacacactctacacacaggatcccatttaatcctcaaactcccctgggggtcccctggcagggaggcttctcaggctgaggtctgggcagtcacacagggcctggtactcaggagggccctgcggttggttgcatgctttgctgtcacttgcttggaattcctaatcgttttttagcaaggggccccacacttctgttttgcactgggctccaaaatcattggtgtttatgaatccctggggagatgcatgtctttcctccttcatttctttcacatttccaaactctgtcttcagcattacccttagaacatcagaagtccctgcaaggcccagagctcctgtgcccaggatccaggctccctaggtggcctcagccaccccttcctgaggggctgcaagggcggggggttttgaagatctctgctgtcttttccacaccctctaccaatactccctcttaagtttgggtgaaattactcttcctctctctcttgttcttattaccttttaacctcttgcactcaaggcattccctggttttgcatccttaataaggttaggtttacaggagacagccacaaccttgtcttgtttcaccttcagtaccatgtcctgggcatacattcacagatacaggaaataactttgtggggaagggtattaactccacacttgaactgcctgaatcctcattttttttccccctattgctagcttgctctgtgacttgaggcaagtaatacaaactttctatgctgttatttcctcatcggttcagcacgtatttactagccccgttgagggcctggcgctgtccatggggttaatgataatgccacctcctaagcactcacgggcactcacgggcacacggcttggttaagttggtgagaatccttactgcccacctgcagggcttgcttgtttatctcaaagtcgacttctcacaggtgctactgtcttttttgtcatttgctcatcatctttgggctttccgatccagtggggtagagtttgccagcatgtgactgaagaaccactgcattagaatcagctggtgacctgctgggcactctgaattttcaacaatctgacatgcaagaacacactaggtggagaatggcttgagcaggcagtggttctcagccctggggagctaaaagtaatgaagtcttgctctggtccagaccaactgggaggaatatctgggaggggcgcaagcatctgtgtcttttaaatgctctctctgtagattctggtgtacattgagggttgggaacaaccatgcctggccctttaccatatcaggccttggaacatgggttttaagaacactattaaatacgagcctctgcctgctttcagttttcccctcttggaccaaataattgggagaaaaggccattttcttccccaaatggtttgttctctttgtgtgctggaacatagccttttcctctgtgagtttgcagtgccagcagatcaaaattataatagcaaatgacaaaagctaagttgtaagataaggcagagtaactaagactctaggaaaggcccatagggcacttcatagttcctggcactgccaccttacagggctcggatgtgaccacacatacagcaagttgttctgtgctgagatgtgaacttaatagaaagatcctgacctagcacaaaacccgcgggttaaaataatagcataatgtattgattcattcctcagtgccagacactgggtcatgtgttgttgtgttgaattctcacaatgctatgaagtgtgagtgctaataatctccactttacagatggaggaactaacgatatgaatgactaaataccttaccatgtcacacagctggcaacggctggtatataaatccagttcatatatttaactgttcaaaataaactagtggtagaaaataagcaatgtcccttagtaatgaggtctgatttgatattcacagactagatctccccatggccaggcttcaggactgtagcagagggaattggaaggttgctgtttctcttctctggtctgagtataaaatcagggccacggactggtgaggatttggtcttggcataagaggatttttttggtttagatgggtgatttgctctctaccgccatctgctggctctctgtaccaagcataggcccaagctccacgtttctcatcacaagtggcacagggtatggtgtccaaatgtggacacctcatctgtgtggtgaaacgccttcagttcacagtgtcaaaagtaacaatgatgtgtatttctccaggaaagagaacttctgtggttttaaataatgaggatggtttctcctgtttctcttaactactgatggatttgtaaccatattccaaatactagcttatatttctctgactcccagagcagaatagaaagcagtataagacagcttcgttgccttctaatgctgcagctgccttggtcagcccagctgggacatcatgattacatttctgttctctgggtttgtgtcagaagtagaaactaagcctggatagacaggagaagggaattaatgtcagaactttgtcagggatctgccattcaccaaggtctcaccagaaggttcccagaagagactgtgtggttctctttaccactcttgcatgcagaagaacaattaggttaaaaaaggatggcaatgggatgttattaggaaacatgaatacagcttttgacacactgatgtcttcctttttaaaatggttatctaaggaatgagagtgacctggtattgtatctattgcctggtggacagacgccatgagattgacttgtctgatgtgacaaaagacaattgatgtgttgaaagaactgagtacttagggagagacgcagttgctctctgagagaaaatgttcacagctcattaagttgatattgcaagcaatgaaaatgtagcaactccttctcttgttctcttcccttccacccatgtgtagccagaaataatccttgctaagctccgcctttacgttggttagttcagtggaaccctttttcaaatgaaatcggagatggtgaggtgtcaagggaaatgcagcagtgggatcctcaaactcccgcctcttgctgtcctatttcctggccctctccttgccaggaacctggcactcttctgaggaatgcaagagctccctggatatggtctgaaaaacactgagtgccatgtgacttgactggttcattagtctgggctgagttggaaggttttggtctttgttcctgagcctcttaaaattttttaaaagagaggatatatagatatatatttaatgtcgatatttaattccaggttgtgggttattataatcttttttccttgctgaatttattcccccaaataaggttaaaaatagcaggacaataaatacagtaaaaaagtagattatttagtttttgctgatgttggaaaatcattaactctttgcttcctgataatgctgaagagtacagcattaaatcctttctgtaataaagcataaatagatacttgaccaaatacagctccaggcccttgggacaaattcaagtcatttggccttgagaggccagacatgctgttggaggccttgggagaactggtgtgttcatgcttacagtgaagccatggattccagacctgcctggaaaagggccgtgtctttaaaacaatcaatggcattataaaaggactatgatctgaatattcaataacagttaaaatatataacgtatcactaagatgtaatgtatatgtctatatctgtatacaatgtatgtgtatataggtacacatatacatttgcatcactttagtttttgatgcatggatatctgcttacatatgtctggcccctttttcaaatgtaatcttcattacggtaggggcctatcttgttcactgttaagctccactgtcaggcacagagtagtgctgaataaaaatttctgaaataaaggaatgaatatatcccatctttgaatgttcttactgagtaacaagggtggtatcttttatttcttggcatctccaaggactcaaatatttgattttgatgttttatttcatttgctcagtaatctttattgagcatctaccacgtgacagtcactgtgccaggtattgaggatatagcagtaaataaaactgataaaactctcttcacagacctttctattctactgagaggaagcagacaataaatacagtaaaagtagattatttgttttttgctgatgttgaaatatcactgactcttcttccttcctgatgatgctgaagagcaaagcattaaaccctttgtgtaataaaagtagatgatgcaaagcctgctagggagacaactaattcagcccctcctcccaagcccctgcaggagctgagaaaaacaccagggagaaaacgggaatatgttgactcctgagtggtaatgaaaccccgaaaagggtaggcaaagagatcaggacaaggagggggggctgtggcaacaggatcatgggcgcaaggccgtgtggttctctgcagctgagctgcatgccctgtcagcttgcaatgacatcctgactgctttcaccatacatctgtccttcccatccttgaaagcccatcctgatgtttgcagtggaggattttgattaattgaccctgaactactgttgccagggtgtctctactcctcctggcgggaataatacatcggcctgtgtgctttttcccaccatttcaagacctgtagcaatgaattcagaggaaggagtaaagacagttatctcatgtatttgtttaaagccttatgccttgaaaaactactttctcttaataaatgcatttatctcattggatcctctcgggaccacagtgaagtgattaagatcaagattatagttaggatgtccgcgtaccccaaattaccccttctgttgtcccagcatcccagctggtttagtatttgtcttggcttttttttttttttttttcttttgagacaatcttgctctgtcgcccaggctggagtacaatggcacaatctcagctcactgcaagtccctccgcctcccaggctcatgccattctcgtgcctcagccacccgggtagctgggaatacaggtgcgtgctaccatgtccagctaatttttctatttttagtagagacgggatttcaccatgttggccaagctggtctcaagctcctggcctcaagcgatctgcctgcctcagcctcccaaagtgttgggattacaggcatgagccaccgtgccttgccattttttttttaatagactttattttttaggacagtttaggttcagaacaaaattgagaatgtagagagacttaccatataccccttcccacccacaacacacatacatagcttccctcactatcaatgtgccccaccagagtggtacatttgttccagtgggtgaagctaccttgacgtgtcattatcacccagatgccgtagttcatgttagagttcactcttggtggcgtatattctgtgggttttgacaaatgtgtaatgacatgtctccaccattatagtatcctacaggatagtttcactgccctaaaaatcctccatactctgcctgttcatcactctgcctatttatctctctgccccagatttttaattttgcagtaaacagtttttagaatgttataattgaaaatactttgatagaactatttagtaggtctttcaacataagaaagctgcttccttagtcaaatacttcaaagtattatgtaaatttagttttagagcctcttaaaggcgttctaattggaatgacagattacttggtcaccataattacagtctatatcttaaggggagaaaaattggtccccagcaaggaaagaatactcctatgtctagccagctggacctagagcaggagtagaggccaagtcctcgaacgtctgatactttctatcccagagacacagtgcctgctggggaggcaaattggagcccatcacatcctggccttgttttaaagtatttaggaaattgatattgcttctgtatttctaattcggattcaaaaactcactgcctaaacaaataacaaacccagtaaggaacagaacagactgcaaaaaatccaagatactgagactcaggcaagtgaggacctgcctagggaggatgaaatagtactactgagagggacgtgtggactttaaaggagtactatgcttttggagaagaggcttgtggagaagattccataaattaagtcggtgaagaatagtattttcactgataaatgtttgatggtattttgagattgaaattggagtttcatttgcatatttctgagacatggtgcatctgtttattccgtaggatatatctagattctgatcaaatatgtattaaacttgtttaatatgatcatcagctgttctgtagtgtcacccacgtataattttaacacaatgttattcctaaaggttgaactgattcttctctgatagcaaatctgaaggaaattattctgaaggttaggttttcatgaagaccaatttatcatcttatatttacttgatgatatagtatttaaaatacattctactgtttaagaccagcctgggcaccacatagcaagaccttgtctctagaaagaaaaaaaactagtctaggcatggtgttgcacacctgtagtcccagttacttgggagggtgaagcaggaggattactttgagccccggaagtcgaggcttcagtgagctacagtgctaccacactccagcctgggcaacagagtgagaccttgtctctaaaaaataaaaacaaacaatcctgctgtagaaacacatagttatcctaagtcaaggaaaagcagccactcttttgcaaactagattacaaggggtggaggaaacatccagcgcttgtaagaaaataacacagaatgggctgggcgtggtggctcatgcctgtaaacccagcactttgggagtccgaggcgggcggatcacgaggtcaggagatcgagaccatcctggctaacacggtgaaaccccgtctccactaaaaatacaaaaattagccgggtgtggtggtgggcatctgtagtcccagctacttgggaggctgaggcaggagaatggcgtgaacccgggaggcggaggctgcagtgagctgagatcgggccactgcactctatagtctgggtgacagagcaagactccatctcaaaaaaaaaaaaaaaaaaagcacaaagaatggtggcagagttgattctctgcctccaagagtctttaagatgtgtcacatttgatggtatcctggttaaagggcatttactttagggttttgtgtgtgtgtgtgtgtgtgtgtgtgtgtgtgtgtgtgtgaatagtgtgaagatttgcttttgttttacttatttttgtcaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggtgaggccctaccgccgtcacctctctgacttctttgagatggatttatttgcccaaatttgcttattaatagaaggataaagtgcagaacagaaccacacagtttccaaatgaaacgttaagacatttagctcatcaagtgggtttttggcattttgctcctgctgttgtctttcttggctgcatcttaaatcatggaaatgttttttagaagtgaaaaatgcttcaatactggtgatgctggcttccagatctttctaattggagatttatgagctaagcacactcatctatgatgaaaccatattgtcccctcgtgcccttggtcttctgcagggggctgcatggagattttacaattttgttaaaggctctctcattcatcatcattagaacttaaattctgattctcaaaattgtctttagcacatgaataagctattatttctttttaaagtctcagatgaaattttgaacagcatcatcagatgaaagaatcatggggcctgagaaagtagtttactcggagcctccagctttcttgctgtggatcatttttattcttttgagagcccaactgggtaaaatgagcacaatgacttatgattccagtatttttgtacctattaaaggaatgaacatatgacttaaaggtttgggatgaagaatgttaccccaatttcagtattttattacttagtgctgagctttagatatgctcaatgacaaacaggccagaaagagggagagtgtgagaggaacagactgatcaatcgattgaatggctactgcctctgggttttgatagctaatatagaacaatgcaaactggactaaagctcactagttcccacctcccttattttgtgtgtttatgagtcgcatcaaaatacaattagtgtagtcattaattctgttttttccatctctaccaagcacgaaaacctcattgatctaaaaatcagtgagaaaaactaaaacaactgttgttctctccttgtgtgacataaatggttatttggtttatacttcactttactcacttctccttttttgtttttgtctttctgttactcttgaattttcccgcttattcagacacgtgtgaaactcatacccatccagaaagaagtgatttcaaggaagtccttcgcttttatgtttcaacaattgttaagtctcagaattgcaaacatccttgaggagccctgactgccagaatcttattccctttaaccattaatttgactagaatctttaatacatttttacactaagtattaaaatttaggaaggctaaaagtcataatttcttgagaaagatgagcatagtgacttcagagggatagtaccatttactgaggagtgatggtttctttactagtaaagcaagggttacattgcttaaaatagtacaaggttgaaacagcatgagatcatgcatgatggatgaggtattgagaacatactcagcttgaggctgcacagtacaggctgcctaagggaccggtaagctatttactgtgcagctcagcatggaagggatgtgccccatcccttctgatggcagaatgctttgagagaaaccgtgctgcatgtgacttattcttgtctgtctgttgcagagctctaggttctcagtctcccagacactagtttgtgttatcagaagactatattttaaaaagtactaattgatggaagtcagataccacaattgcacccaacatgtaaagccttatttctatcttcagatgtttcattcaggctcactcagtttggggtgcctggatttaggtgttgtggggatgggaatgtttgctgaaagctttgtttgagctgcaattgcccctcgtttgccacttctccagcagtgactgtgcttactggccaggagtcctgtgaggtgtccacccccacaaaagtggacccatcacttgggcgcccagggaagcttgtgaggagcaacagagggggatatcatttgctcttcttcatcttggacacattttcttcctaggaaggccaacaaatgtaacatatatttcaatctgtgtgtgctgaaataactattactggaagcacttttatatatttacatacatatataattatattgattatgtatactgatatgtagatatatagatatatatttatattgatctatatattgagagatatatatttgtgttgatatatatttatattgagaaagagatatattgatacataatttttttttttttttttgagacagggccttgctctgtttcccaggctggagtgtagtagtatgaacatagctaactgcaaccttgaactcctaggctcaagctatcctcctacctcagcctcccaagtagctgggattacaggcatgccccaccacacccagctatttttaaaatcttttttagagatggagtctcaccatgttgctcaggctggtcttgaactcctgggctcaagcaatcttcctgccttggcctcccaaagtgctgggattataggcatgagccactgtgtctggcgcatactttttaaaaagctaataataatggcatcttatcctgtaagtactttttaacatgtatgtgtgatgaacaacccttggtatacataaaggaccacttaatttccaaagtgaaagtaatattttgtatgaagtagtatttttttttttttggagacagggccttgcactgacacccaggctggagtgcggtggcaggatcagccttgaactcctgggcttaagtgatcctcctgcctgtgccccccaagtagctggggctacaggcacacactaccacatccagctaatttttgtattttttgtagagtctgtgtctcattatattgcccaggctattctcgaactcctgggctcaagtgttcctcctgccatggcctcccaaagtgctgggatgacaggcgttgagccatcatgcccagccttaaattttttttttgttctgtgaatctcaaaatctttggaaatgttacctcatttgataattcttgctggtttccttcaaatcatgaaaatgacccaaagatgcactaaaacacctttccacactcgctgacaggccatgataaagggctctggtgtgaagttcctatgtcttttcttgttactgttggtgtggtgagcagcccttcttgccttgggctggccgatgaccatgggaagttggttttgttttgttttgacttcgttcttgtgcctaggctgtggagcctggctgatcatgccttgatcgcccgctgtaacatggaagaggcggttcgcagtgtagctttcagccccgacggatctcagctggccctgggcatgaaggacggctctttcattgttctccgagtcaggcacgtactgatgttgaaaatggtatttagaaatgctctcgtgttaaatgttacaattttcctggtcataatacatgctaggaccttaggaaaaatccatttagccattcaaataggaatactatagatctacgatcccctatctgtaattctgaagtcctaacactctgaaaatacaaaattatttgataatttggcagcacagtctaacccaacagactgatgtgaggctgtttataatctagtaatctcttagtagaaataatcatgtgtcatgtgacttgctgcaaaattattgtgtttaatacagattgctgccccagcccccactggggatgttacatgatacattgtgtatgaacctttctaaaatctaatgaataatgaattcccaagcacatctaattccaagggttttggataaaagattgtgggctttgtagtaagccaagaaaagaggaagaaagaataaagcagcacccaacagcaccagatgtttagaggtgagctttagtaaaagatttcttctacccataattgatactaaaatggaatatttcctatttactgacatcctatatactttttactgaaaaaaattatgacccactcttgtaattcctctgaatgcatttgtcgttctctcgactcacatgttttgtaattatagaaaataaatgcagctataaagtaaatatttcccgctttgcacagagaattctccatagctttgattggagaatggtcttagcacagtttattacactacattctcactaccaaccacacataactcattactgaactagtgggcaacattttctttctctgcttagtgacgtgtgaaaagatggctgagtaccagatttctttttcgatggacttctcaagcttccacactacacacacacacacacacacacacacataaatttccagacacctattttatgacattctagtacaccataatgctattaataaatgatagcaggtatgagcgactgttatgtagaacgattatttgctattctttatgtattcagtttatttggagttgatgaagccatctttactggctcaggggacctgctagttgtcataatcctgtctcacaattgtagggaaaaaacaaccccagtgagctttccagtgtgagcagaaattcttaaaagaatctggtcagaaacaaaacaaaatattccagtgactcactgtattcatgacagtgaaatgttgaatgattacatcacaatttaacatttaaaaaggtaattttcttcagctgcttttttgacttgctctttttgcgacaataggtatcaagcttaacagtcactcgtttcttaaagtataaaaaagatgatttatttatgttaatcttgatacagtctccctttctccatggcgtatttttaaaacaatttgacaaaccccaacttttgaaacaaaaattttagggaaaaataatatatagttaaacatgaaagcaaatgtgcatttctttttaaaattttaaaaatcgatacataatagatacacatattttcagggtacatgtaattgaatacattcatataattcgtgaagatcaaatcagtgtaattgggctatccatcaccttaaatattttttctttatgctagagacatttgaattattttctcccatttggaaatatctgatagattattataacctatagttactccactgatctatcaaacgctggatcttatttcttctatcacactgcagtttgtgcccattaatctacttctcttcatcacaaatatgcacttaattaaattttttgtttttactttggaagcccaaaatatcatttaaacagtttgttattctcctaaaatgccataaattttaagacggagtcttgctctgtcgcccaagctggagtgcagtggtgccatcttgactcactgcaaactctacctcccaggttcacgccattctcctgcctcagcctcccgattagctgggactacaggcgcctgccaccacggccggctaattttttgtatttttcatagagatagggtttcaccttgttatccaggatggtctcaatctcctgacctcgtgatccgtctgcctcggcctcccaaagtgctgggattacaggcgtaagccaccgcgcccggccaatgccataaattttaaataataacattttatatatttactcaaaagttaatcctttaattcctgcaggtttggttctctttcaacacacttctttttctgacacatatattttaaaacttggattttctatttgtagaattgctgcttatcgttttgctttttattcttacagagatatgacagaagtagttcacatcaaagatcgaaaagaagtcattcatgaaatgaaattttctccagatggttcttaccttgcagtgggatccaatgatggcccagtagatgtctatgctgttgcccagaggtataagaaaattggagaatgcagcaagtcccttagtttcatcacgcatattgactggtccttggatagtaaatacttacaaactaatgacggtgcaggagaacgattgttctacagaatgccatgtaagtcatgtggaggccttggatgtttctggaaagcaaaattttgaaccaggtgaaggaaatacaggacaagtgtcatggctcttttagaatttgtacagcaggttttctggtttttgccggaaagcacccccacctcagggcaaggaatgttttctgtcgcaagatcctaaataacagacattcaaaggaaaggtatgagttggaacatgttaaactaaaagttgctgcacaacaagggagatcgtgaatgaaatgtaaagacaaggcatagactaggcataaattcttgccattgttataatggacaaaagatatatatctagaatatataaagaatgcctaaggataagagcaaggaaaaaaaaacattagaaaaatgggcaaatctcacatgaccaataaaagactaggaatcagggaaatgatcattaaaacaacagtaaagtaccattttacactatttagactggcaaaagtctgatggcgagaagaggggaaatggaaaccacatatactgctggtgagaacatgcactaaggcatgtgcgcacaaggatgtttgtgacacaatgcctaaatgtttatcagcatgaggagagttgagttaaatgtggtgtagtcatataatggaatactttaaagaacttgaataaattaaactagagctacttgcatcagtagggatacatctcaaaaatatgctgagcaaacaaaagaaagttgtggaatgatatatacagtgtatggtcatttatataaacttttagcacatgaaaaaattctgtattatttatgaccatatacacatgtagtaaatgttttaacaatgcatgggaatgatacctcattcaggatgttggttaccgctgagaagcagagatgatcttggaaagaataacccaatgaggccaggcatggtggctcatgcctgtaatcctagcacttttggagactgaggcgggtggatcacttgaggtcaggagttcgaaatcaacctggccaacatggtgaagtcccatctctgctaaagatacaaaaaaaaatcagccaggcgcggtggcgggcacctgtatttccagctacttgggaggctaaggcggcagaattgcttgaacccaggaggtggaggttgcagcgagctgagatcgcaccactgcactccagcctgggtgacagagtgagactccatctcaaaataaataaataataaataaatttagaaaaaaagcccaatggattttaactctgaaacattttctttaaaattctgtgataaagacataatgttaggatttgttgaaactgtggtgcaacacttgtacactatagtagtctgtataattttctgtatgctcgaagtatttcatagttttttaaagtagagaaaatctgaaacaattgtagaaccaactttcaggtatttggatgttcatgacctgtttagttcattatccaagtcttttgctttatctgttatttcttctttattcctgatctttgcccatttcattgttcattaatgtgtacctaaaaagttgactaaatggtgataatgcaaaatagtcataatgcttctgtcagtgccttgcacacacaattctgcagcagggttagaaatgaatgaaaatgaactggaggtatcatccgtgggtttcagcttgttgggcaataatactcccatcgtaacacagatatccagggatagtcggctacattatcattaggaaaactggttcctgccagaatagaaaagaatagtctattgaaattttagaaaaaatggccctgggagtattagaaactctgagatcagcttagaactccaacacaacatttcaagatttaagtcttcaaagatttgaggatcatagtccttatttacttggattgttttagtcccagatctttgttcttcataattggaatctcttactggttatttggtgaaatgtgcccattgggattttttaaatgctatttttgtgaccccaccataacttttataagagattcatctgacttacataatactcatttattaacatttagtttgtgtgatgctaaaataaatgtcacaaataagactctgccttatcaaattcttcagtgtaccattgcagaaatatgtatttctttgttttctttgcttgacgttacttcatatattttttctatgtgaaaaaatattaaacacatgtttatcatttgcaataataaaataccatcctgttcaggggtggcatcataatttacttcatcactgtcttattattgggtatttgagcttatttctagtatctttgttggtccagctgttggaattccaaatgcccctgtactggtggaattttctctcctgagttacttcctaggactgtattctccaaggcaagaacactaggtgaaagactgtgttccaactacagacgtttttattttgttgtctctttaatgaagttttacgtaatgctgttacagtctagaattttaaggtgccaatttgataatgcaccagtattatataagggcatttattctcaccagttctttattttgaaaatacttattctgagagagaagttaggtaatatgcttaaatgtcttgattttgaattttaaaattgtgtgtggttaaacactttcccaaatgtatgtatgtttgcttctttgtgtgctctctggggaacatccctgacctgctgtggtgggaactgggtagtgggccatccccatttgggaatatacacagcacaacggtcgggattattttcccgcgtgaattacattttatttcatcataatcttgtagattttcagtgcctagtacttataaatttaaataatattcactaattttttttcattaatctactgagcctgaattttaaagacatcacttctgagcatccttaaattatgaaaaatagaagttcaggatgaacttagccaaagtttttaaaacctggcaaagcgttggtgactaaacatgatgatacatgataaaagtcatttcattaataatacaaagcataataccatctgtatcaaggtaattaagtaattgttagtagcttgagacattacatttagtatgataattttcttaagttttttgatacattcatgtgtttattgggtacatgtgaaattctgtgacattcatagaatgtgtagtgatcaagtcaggatatttagggatgcatcacctgaatatttcatcattttctttttaatgtctgagttttgagtgtgggctttctttaagccacgcaaaaaaagaaaaaatcgcaaatgggataaagagattaaaatatgtagttttctgtatttacaaaagttttcttaaagtttcagatctttataaaaaataaattagaataaactttttatttaaatgtaatgttaatattgattattttcagctgggaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtctcaagagaggtaaggccaaaagagatgtttcattgcataaagatttactctaaactgtatacagtacaattaaggctgatcttcctgctgtctattccaatgcactgtttattttatcttgtatattcttatttacttttcaacaattttaaatagaatgtgttgatgtcttctacttttgacatcttaagatatgtggttttgcaaatttaagaaagaatttgctaatagagttattaccatattgtgatttgtaagccttgtttcacatttcgaacaagtcatatttatgtaaatattcatagtttatatatagtccgttaaaatgttgtaactaaaattcttttatgattcagagctattgtgcttatacatggaaaagcaaaggaaatcctttcagacataattaaaatctgatcatggttgtggtgataatagtttatggacctctcgtcatagcagtaattttgcaaactagatttacataactggtgaaatttttgagagaagtttgattcaaagcaaccctctttgccctcatgttttgttgttttgttttgttaaaattgtttgacttcagttatgtggcacactcaagcgttgtagaaggtgatgaattaaccatgtaatgacctcttcttcctttgcaagtttaggcaaagcccatattcaggctcttctgagactcctcaactgtgcctgaaaatccgatcttagaaaagtaatcaacagggacatgctactgcctgaaaactctttcacttgaacaatttttagactaagcaaggaaagggattgaaaaatgcaatcagaaagtcattttcagctaactggcagttttgaagcagtgacagttatggtacaaatggaacataaaatgcataacaagacaccatcactgaaacatcacaaaatgaccatccgtttaaaatgtgcaaggcacagaattatctcaacatgcccaattcatactcttctttttccccacaagagccctttgagtaatagggcatatcttgttagattgagtagtatacttgcagggggtaagttaggcctccaagaaagtacctgggaattcagaattgagaagaaacaacattggggtcagtggcaacactactggtctctagtgtcagaacttgggaataaacataactcgatgataattgatatcctatacatcccaagtcttttaaggtgtgcttgggtctggaaaatagcaatggaaatgtggatctattagaaaagaaagcatgtgttagtctattcttacattgctgtaaagaagtacctgagacttggtaatttataaagaatagaggtttaattggctcacggttttgtaggctacacaggaagtatgatgctagcatttgcttggcgtctgggcgaggggtgctcaggaaacttacaatcatggcagaaggtgagggggagaaggtacgtcacaaagccagagcaggagcaagacagagctagagcagggttcctacacttgtgagcaagcagatctcatgaaaatttgttcacttttaggacagcaccaagaggatgatgctaacctattcatgagaaattcacccccataatccagttaccttctaccatgccccccccccgccctctaattctggagattacaattcaacatgaggtttgagcagggacacatgtccaaactatattacagagggtgagtagtgctgtcaaaatgagtcaccgttacataaaaaacagctctttggataatggcacacagagggcatctgcatgaatgaggagagatggacagccagatgacagtatggtgagaagtagcaaaacccacctcagcaacccacagacatatccatgtcctcatagcaaatggacttgtgttctacttttcatgacacatggcttataaatcttgtaatttgcctctgagacattcaggcttttgtgtcctttttgtgccaaaactactggtggggaagtgaataaaagagtgggaattgttgatgggaatactagcagttggtggaatgtgtctgtctgtaatttaggtgacaaggtacaagtattccctgtacattttgaacctgtaaacagccagatatgggcaggtgctgatgaccatgagcagttgtgggaaatgagcaaacattattgttttccattgtgatttttaaaaactcacaaccaagttaatttgacatgtttgcaattatatgtgtataacaatcagttgcacagtaattagacgtaagtgttctgcagttaatgaaaatgactgctactgtactatgtttacgtagccaaaccaatttgtttttctcattttgacagttttcacatcttaaaataattaggatcaatactgacagctttccctgataccacttagactatatcctgtttgaccatcgccacacagacactgaaacgaggtaaaatccaaggccttgctcaatgacaattttccatgtcctaatagccttggtacgcacccctactccaatgggagactcagaggctctccatgttccacctggtgcacccgttccattcctcctttgcattacacctcagcaacccacaaaagtatccatgtcctgatagcaaatggacttgtgttgtacattttatgacacatggcctatggacagcttgaacagccacctcccatgatgagtgtcctgaatgttaagacttgagttgcagaaatcttggatcttagatcttggaggggctggtgctggccttccatatgtcatggataagcttgatgcagtgcagaagcaggaaggccagtgtggctagaacttagtgcatgaggggaagagttgcgtaccgtgacattggagagggtgacagggctgtgtcgtaaagggccccctggccactactagaaatcagagtcgtcttctaagtgcaatgaaaaactatggatggttttacatggagtgatgtgaccaatccaagcttttaagactgttttgatattttgtggaatggttaggaaaagggaggtttcaagtagagaagttattgcaggagtccaggtaagagatggtgtggcttggacaaagatactaggaagagatacagaaaggttggtcgggcttaggaaacagtttcaaggcagagctgagggtcttacagatggactggatatgagaatagaggaaaagaaagtaatcaaggatgacttctaagtttgggacttgagcagtgggttgaatagtggcagcatttacagagctgggaaaatgagaaaaaagatatttgtctctgggagtgcacataaggggaagaggaatgtctcggtctgttttccttgttgtaagttaggggcccgtactgggcatccgggtggacgtggcacagagctgtcagtgctccagggagatgtcagggctggagatgtgcacttggcagtcacgttgacagcactttaaagccatgggggaggaggttgatagagaagacatgagggctgaggcctgagccctcctgtggtgcagaggacaaagggaggtctggtggagtcattcagtgtcccagggaaagccttatgagagacaggtgtggccttcatttattcaagaagtgttcgttaaatgctgtcctacgggatggagataggccagtgatgaaaacaagcacaaatccctgccctcgtggagcttttgttctactgaaggtccacagttaatatacaagaaaatataaacatctgattgtgagaagtgctgtgaagaaaaataaagcaaacagtgggagcagagaatgctggaattgggcagtgcagtgttctaaatgagttggtcaaagaggggcttgctgttgtggtttcatttgacttagaacctgaaggagaatgaaggatccagctgttcagatatctagggagagagcacttcagacagaggaaacagcaaaggcctagaagcagagaaaatgcctagcatgtttagggaatagcaaagagaccaatgtacccagagcagagtgagtgagcggggagagagggcagaaagaaaagatgagagagataaggcctaagtattaatgacattaatgcttttgcaggttctagttccagcttacaaaggctatattaattatctattgctgcataacaaattattctccaaacttaaaagtgtaaatgcacaaacatttattatatcatggtttctgggagtcaaggagtcccaagaagcttagctgggtgattctagttcagggtctctcatgaggttgcagtcatgtgaaggctagactgaggccagaggattcgcttcttccaagatggctcactcatgtggctcttggcaggaggcctcagttcctgctgtgtgagcctctccatagattgctccagtgtgcttatgacgtggcatatagagatccaagaaagacagcaaggcagaatctgcagtaccttttataacctcctcttagatgtcagcttcacttttgccatattctgttcattttgtatcagagaatttgtggacatatttttaaacctctgcaaagagataggctaattgatctgtgaggaaggtataaaggtcaaggaagcaaagaagaggccaacactttaagatctaaagagagttgggaagagcataccctgctccccaattactcaatcatgagccagcatttccagctgaccttagttggagccagtttgactttattacgaaactgatttaggtaactctttgaagtaggcaagtttgcttttgagacccaatgcttcctttcccttctgcagcagaattcccctaatttttctcagagcccctgatataatgaggcttatctggtcagagcatgctctcaaaaaatgtatgagcatgacatgtagcagtaattttcaccttcttacaaatcattgcctctccagtggacatttgaaatttaaacatgtgatagttgaacagatggcctcccccaaccctaataaaagggatttcatttagagaaactgtgagaaatagaaatgtttttgaagagaggttggggtatttgacctcctgaaatctaccatggactttggggttctaggcctccatgtaagatggaccctgcttattactcgagtgccttgatgccgctgtgtactgagcatatgctgatatgctgaaggctttactactgtagttcaaccacaaatatcacttcaagtagctttttctattgcactcactacctggggttagtgttcactgagtaaagcaaccagtttaaggaggaaaaaatgattctccaaactctatgtctacgtgactccaaacaataattttatttccatagaattattttctgtttccctgttaaacaggattgcctgtcttatctttcatttaaataagaatgtgtaagatgttcattctctgtcatttattttcagaatcagtgaagcagtaggcattatttggaacaggttcagatgtgtctttagccacagggcttaaattttacgacctatttttagcttactgcatattggaataattgagatatattttgaagcatttggttatttgttacaatatgtaagacggaacatcgttttcagatatatttaaagattttactcttcaacatgaacagaaggggggttgttttaaactaatgaactcttcttttttcataactaatcctctcaaaaaatattctttcaggagccaaatttagaaagtatgtgggccattctgcacatgtcacaaatgtccgctggtcccatgactttcagtgggtgttgagcacaggaggggctgatcactcagttttccagtggaggtttattccagaaggtgtcagcaacggcatgctggaaactgcaccccaaggtaaacccagcaataatttcttaacatcattttatttttcaataggcatttcaaagaatggtctaacatgtattctataggtaaaggatttaagcaattttggaaaattgattcctgtaatcttaaaattttaagataagaagaaactttaaagattaacatgggtcagttggataattttcttcaaaggaagttgctataccaaatgcaagttgagcaggacgtcagcaacgtgacatctgcaatgtcagaataggaagctcctgacactccctccactcatggacaccaaatacacattgattcgcaggtccattctctctgagagaaagtcatacaagttgagaaactcctacccaccaggcaactgagaaaacatccacattgggtaggtaggaaaagctgaggcacactctggcaggaaccctaccctgcgcactgcttcctgaaatcaggacaggaatccccaccacccaacctctccctgtggagagaatggtttggacctcacacatagtgccctaactctaggttacccgtggactggctcttaattcaccaactctgggagtagagggagttagacatttgggagtctctagaccatgggaaagaagcctcggtttgatacaagtgctcaagccttccagggacttcatcccctggagcagttctgagaaggagcttaaaaaatgcagcccagtttctacctagaaggggtttatgacacatttccggaggctacttggcggcctggcttctaaccaatatgcaacagggatttagaggggcagacacacattaacccagctggcagcctaagaaacagacctctgagcctcctcccatgactcatcccatcagtaactccagatctaataatatactctggaaggagtttgtccacacattgagctccccaacttttatagcttccactcaaggaaatgcatcctaaacctcccacttcggggagcagagggggcaaagtatatgaatgtctgtctagaccatagagaaaggtggcagttttatatggacttgtaggcacttgcagcggcttcttctcttaggagtggtgacgagaaggtgctataagaatgcagctcctcatttctccccagatggggtttatgccatgtgttgaatgcccaacttttacagctacctcccagaggactccatcctaaacctctttgctctgggagcagaagggactaggaatattctagtcttcctatatcacagaacagagatgtggtcttaaatgggtttacaaacacttacaggagtgacatccccttggagcagtgcagaaaaaggttgggaatgtgcagctcccattttttttctccagaaggggcttacagcatacacttccaatgctacttgatggcctgccatcaaatgatttccatcaaggagctaacagggcaaacatataatagccttccagcagccagagctcagcacttcatgagcctttgctctggctcgccccagtgataaatctaagcctacccatacttactggaaaaagtttggtcatacaccaagtgccacaccttctatagctcccacctgtctccttaatgaactagctctggaaattgatggggcttcgcattcctgagtggacttaaaccacagaaaatgaagaggtagaggtacaatgggcccacttcaggagttatctccccaggatcagagggtacagcctaaatgtgagtacaggcatttgtcacagattctctacctggcttagtgcagaaaaagtgagcggtaaatgactgtgctcagcttcactgtgaagatagaaggaattgaaacacatagtccaccctccaacccttctagctacatcaaaagtgtcttgatgtcttcccccctttacagtcttgcggtaccaacaggacatggcacatcttaagctctaggggccaccaaaacagacaatagtctggacaaacacagatttgagaggcaccttaaaaccattggccagtcagattggtgagatccttctcctatacaaggccagtctgacgagatagggagaggttttttgttttttttttttttttaatctaatgcacagaaaccaacacacagtgtcagtgacaatgaagaaatgaaattccagataaacgagcaagacatctccagaaagcaaccccagttaagtagagatatgtgatttacccaacagggaattcaaaataatagtcataaagaccctcactgaggtcaagagagcaatataagaacaaattgagaactttagagatagaaggtgttttttaaaactactcaatgagttttggtacttttgaaatactttctctgaggattggctgagcacgttgactcatgactgtaatcccagcactttgggaggctaaggcgggtggatcacttgaggttaggagtttgaacaccagcctggccaacatggtgaaacaccctgtctctactaaaaatacaaaaattagccaggcaaggtggagcacatctgtaatcccagctacaggggaggctgaggcaggagaattgcttgaaccgggaggtgaaggttgcagtgagccacgattgtgccaccgcactccagcctgggtgacataacatgactccatctctaaaaaaaaaaaaaaaaaaaaaaaaaaactttctctgaagagtactgccactgaactgaaaaattcaatagagaggttcaacagcagactagattaagcagaagaaaggaacagtgaacttggaaagacagattactgggaaccatccaatctgagaaacaaaaagaaaaagagtaaagatagcttagagacttagggtggtccaacaacttacgtgttaccaacatgccaaaaagagaagagagagaaatgggcagaaaacatgttcaaggaaataatggcagaaaaattcccaagcctaggaaagaaaataaagccaaatctaggaagcgcaaaggacacgagtaagatgaatccaaaaagatgtaccccaagaaacatcttaaatgatcaaaagttaaaggcagagcattataagtagtcagggaaaagagaatcatcacacataaggaaacctctataaaaccatcagcagatttcccaaatgcaagttgaaggtctaaggtttacgtgaagaattaacccttgggggataacaggagaggatacatttcagcttccttaggacaattgtaacaggcagtgggtctgttcagtcaggctgcaggggaacagggtaacctttgaaatgtaagtggccttcagaatggggctcaagcagtggttcacggttggggcctatgtgttccaattcagtggacatgtatgtagtcttttcatttatctctgatgtcagcaggcatgagcaggtgataaaatgaaaaattatttgaataaatgttgacaagagttctgtggtggtttgggccatgacaattaccaacacttgggtgggcatggttaaaaggctaaagaggatctgtattgaagtaaatggttgggtttatttttgccctagcctttcactttttaaaacctgcccattttacaaaacaaagcttaaaacccaggtatctgctatctaatagaaatgtgtaaatgaccaacctaggcaatgtggtgaaaccctgtccctacaaataaaatttaaaaattaactgggcatggtggtacgcatctctgtagtcccagctgccaggaggctgaggtgggaggattgcttgagccccggaggaggaggttgtagtgagctgagattgtgccactgcgttccagcctaggagacagaccctgtctcaaaaaaagtataaatgagtttagtctgcctggtgggtggtgtggggaaggaagttggcctagtctgttaatgttcctgaaaggagtgaagggtgggctgaactaaaccaaaaggtgaaagaaagatgttttaacaatttatattaaatgaaaactatggtatagtttttatttactttgctaggataaaaggaaaaatattttagataatttcagttgctcagagtctcagaatttttgcttgtttcttgtgggttgtatctctgcagaaggtggagctgattcctacagtgaagaatctgattcagatttatctgatgtgcccgaactggactctgatattgagcaagaagctcaaatcaattatgatcgccaggtcggtaagcagggagcaatgaaaatttgtaaccccagaaggggatctcattcctggatttggacatagcactaaaaatgactggcacttagacaaagagaattgaggcaaaaacaagaaaaatagtctactttgtgcctttaagtgcaggttaaaaccgacgtgtttacccaatcataccattaaaatttatttcagcagaaagtaattgcaaagtttgaaaactgaacccctggtatttgggctttttgcctccctagcacctaaaactttaaaatatattttgaagaaaaatgtgcaagtaagccataggtcttttttcactttcttagcagattatgaaagcatgtgtttcctttacaaggatggatacccttgaggcatggtggtttgcatgtgagcttgttagcccggtttttctattaacttactgcaaccattatccatttaatcaaagtaattatctacttaaagtaaaagctcaaataaaatgtgtattaatctctccagtcagaaattacctctagtaggaaagctgatcagctgacttcagtttttttggaagttgacatatcattttagcactaaacagtgttaaagcaatccctcagcggaatctgaacacataccaccttgttacagcaataaccatgggggttctctttttctttcttgtcacttaacaaagatatgtgaagcagattctgtacatgaatgtggaatgaataagacttcaaatttcagatacatgaactgtaagtgtcgccaatagagatttaagatataggcctatggcagctaccatgtgttgaaagaagtaaagtaacttgcccatgtccacgttgcttgtcgtattaggataacaatgcttacctaggcttatctccaaagtgcacattctatgcactacttggtttgcctctatataagcattaaattggaatatttttcagcccataatcatcagtcattgattcagagtttgaaaaattgtgttcgtaccaagacagtttaatggtttgggtcagccccatgacgaaatcatcttgactgtgcattgacacattgtattatgcaatatgactactaaaaaggacttgaaaagagattattgtctgtggccatacaaccctgaacgtagtcaatcttgcctgaaaggaaattattaatgtggaaatattatgcaaacactaaacaatattatactctggtatcaggagacaataaaatttaaacacaatacagaatttaggaaaagaaatctttaattgggaagtgtttgtttaataaaatggtgctagtagaagaatgaaaagggaccaggcacagtggctcattcctgtaataccgatgctttgggaggacaaagtgggagcatcacttgagaccaggagcttgagaccagcctagttaacacagtctctgtatctacaaaaaaaaaaaaaaactgctgggcatttgcctgtagtcccagctactcaggaagctgaggtgggaggattgcctgagcccaggagattgagggctacaagccactgtactccagtctgggcaacagagcaagaccctgtctctaagaaaaataaataaaagaatgaaaaggtagacttaaaattcatgcctacgacttaaacagtttgaatatccttaatgtgaaaatctgaattctccaaaatccaaaacttcgtaagtactggtttgatgctcaaaggaaatgtgcattggagcattttgtgttttggttttggatttggaatgctcaaccagtaagtataatgcaaatattccaagatctgaaaaaaatctgaaatccaaaacatttctgatcccaaacatttcagataaggaatactcaacctgtatattctccctgacatgtcactttccaatgctttcaccgatatttgatttacattcacaatattcctgagttattccttaacagggattttttaactcaattttacagatgagaatttgaagcccacagaggttatgagacccatttaaacaatagaaatatcaagactagaattcattgctctaaagtaaatagttggtgagctgatgaaagcatcatgaattaagttgaataataatctttagattctagaagcttggttaattgcatctgtagtagacaaaacagtagtgagagttcttctgaccttttacaaatgatttttgatcaaatcctaaacaggggccttatattttatgatttttaaaagagtttgattaaataaaaacttgatgaagatgagaaattattactagattggatttgattctccacctgttaaatggacatttcttggtagtaaagtataaatacacagtaaacaacagatgggtttttatatgcgtttaaatggtacaatcagcagcacgttttaggtcccaagttagaccaagattgatctttgctctgtatctcagatctgttaagatgcatgaagctatgaagtgaatgtgattccaaagagggatttcaggagaaaattgtcatgactcatgaggtccacatttttcaactgtcagaatcagtaagagatttctggccttagaagaaataaaacaaactattttatttatattttactgatacttaatttcctttaaaatttactgatatattttctagacattaagaaaacagtaacaaatcaagaaagattattttaaaatcccaattatttaaaaaatagttcatattagttttattcattaggaaaaagtaatattcattctcatgtcttaagttttcaaagacattttattgaagcaattaaagattttacaagaatgtcaagatgctgatatttttggaacctgatgaaaggcatctcacccagatgtttctgttgtactttaaggtttacaaagaagatctacctcagctaaagcaacaaagtaaagagaaaaaccacgcagtgcccttcctcaaacgagaaaaggctcctgaggacagcttgaaactccagttcatacacgggtgggtggcctgtcatgggcgcccgtatgtgttcctctgtctctgcctggctgtcaccaaccttagcaccaggcttaagggatcccctcccctcagtgtcgtcctcctcctggctagctcttctctgcaatgtgcacttgtacctgtggttgctattttaagtgtgactctctatccacttccctcgttgatgttctgtggccatcacagtgtgattgtctctagatttctcagacttcatataattccatgacttaaagggtgctgctgctcattgctgctgcacttctttctcatcaccatcttcacttcctctttctcctttcccctaatcccctgctgtgttttgctggctccaccataggacagtattttcttcaaatattttctgcacatgtgcccaacataattttgaattttgtaaaattatatgcacccttgcatattttaagtagacaactaaaactttttaatgtcggtttaaatggctgagaagatactatctgtattatgaatacatcagtcctttaaatggatgcaaaggaacctaaatgccataaatgtttgattctcactatgatcaacttaaaaaatatgtgagaccagacacagtggctcacacctgtaatcccagccctttgggaggctgaggcaggtggattgcttgagcccaggagttcgagacatggtgaaatctcatctctacaaaaaactagccagatgtggtggcgtgtacctctagtcccagctacccaggagggaagttgaggttggggaatcacctgagttggggaggtctaggctgcagtgagctgtgatcttgccagtgcactccagcctggttaacagtgaggccctgtcccaaaaggggaaaaaaaatacctgaagaagtccttctaaaacaggaagctattttacatcattcatatttctacctaagttcacatttccattctaattttcccataaaattttaccctaacataatctttttatgcttgagagtcctttgtcaccatgtcataccctctgcaagaaaaaaaatttttctgtggtcctaagactctaactcagcccaatacaatatccactagccacacacagtcactgagcacttaaaatacggctattctgaaaaaagatgttctgcatgtgtaaaatgcacaccaattttgaagacttactatgaaaagaggaatgtaagatatctcataagtttttatattgattacatgttgatatagtaatatcttagatgtgttttgggtttaaaatgttactgaaataaatttttttttctaatatggcaacaaatttttaattaggaggatcatgttatttttctgttagtgttgctccattaacagtttatttgaattatagttattagtaaagtcgactaaatcaacatgaatatattactaattgtgacatataattattaagcacagaaaaattttgttggaaattattttaatatgatggattggttttcagttgcaagatctgtgcatttatattacttactgttagaatgtaacaaagtttaatattgagtctattctcagttctcatttttgtatagatgtaagcagtgagaaagtttattctcttaaataattaggtaagaatggaggccattttatagcaatgttattcaattcttcagactcctgtgataggccaaaaaagtcatatttgattttgatatatcacaaaaaataatctttcagctggtaattccattaagtctctgtacaattttgttgaaagcaaagaattggaaatcacttgatttgcaggattccttagccagtcattagagttgttttctttcaacatgcatacttgtattttgaattgttcctttgttttggtgcccctggaagggtctgtgtcccggagtaatacagtgtaataggattccagatggaggagaggaatggctttctgcagtgggcggaaggcatttatgagaggggagatgggaaaggaatacctgtgcctcatcacagatgtgttctcagatgatcgtttttaagaaaaagcgcacacaacagctgaggatctgctaacagattctgttacaatgttcagtgcccatgtgcctttttgagagtcatctcatgccctcagacggccacatatcctcatttaaacattgctgtcctatgtgacacctggggttccacttgtacatgttcacgtcaatatgttagccttgcctctgacacctcctgctccatgcatttgctgtttgttcaaccactatgcatttcttggacctgtgcttcagttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggtatctatctcctgtaaactagggcctagccaaaaagagaatttaatttttgaattcagtttacatattagaaattcaagaaatgcttggtagaaataaacatgagatgggaaggtgaagattgaatgatcattggatccttccaagatcatgggagaatcaagcaaagcattttagcattattgggagacctctgaggagttcttttcctggaatgatgagatctatgaatgggaccagctaaaactaaaatggtgaaagttttgtcaaggagcagctttatatacttcctcgctgtatgcccaggatttagtatatcctaggtactcaataaatatttattgaatgaaccatttaaaaatactataacatctagagtataattatatttgtaagactgaaaaccataagacttttgactaatttgtattttagccttataaaaacaccttgaattttatctgaacttttttttgaaatgccttaaccttagattgagtctgtaattgaaaaagctgctaaaacagggaccctctacaatcatttgggagtgtaaagagaaaaataatcattaacttattaaagactttattaaacacagatgtattaccttgctggcaaaagagtaatattgtcaaaagtatttttagttttatcttttcctcaaatgtatagattatacttttgttcagtttttataatgagtgtttaattgcagataatacttcaactggtattaactaagtggcaaattctaagaaaacattcttggtataatgtcaaaggttaacatgagacaagcccttttcctgagactcgacctgcaggtggtaaagcctttggacagagttcataacctggggttcatgaaatctatgaatgaaaatgagaacatgaggggagtcaaccccttaaaaagttgtatttgggggaaaaaggatccatagcttttaaatttttttttaaaagggttgcagtcctccaaagggtaagggctgaccattggtttatacatgaatttgctggccctccaactgaaaaggtatatttgggggaaaaaggatccacagcttttaaattgttttttaaaagggttacagtcctccaaagggtaagggctgaccgttggtttatacatgaatttgctgtccctccaactgaaaattagagacctactgtgttagctgatgttataaggttttacaagtaattgatcattgctttgctttttcacttgcccttattttttgtctgtcttataaacagatggtgcttgattcacgtgtatttaatagcctctttttttaagtaaaagccagaggtgttttttttttacataaatccccaaggagttactgcactcaatactgtatttgatggaaggtaaaccagtggcaaacagtattccagcagccacctgcaggagactgggcctccacagacctctgtaggagtggcctggattctgctcatttatgcctatggctttatctcccatttttccttttaaagtcatcacacccaacaggtttccccaccccccactacatattacaagtgagaaaaaccactctactattataattttctttgttgttggggattagtgtgatagaagcttgtatccctgcaaagataatccaccttactgaaagatagttatgccatgaaaatgttatttcccagggggagaagcggggccaggccttcttctggtgggtagcgtaactgagaatgggtaaaataactctggatagcgtcatgacaatgtacaagtgacttccctgactgagaagcagaatcttgtgtcgagctgggaaggcaggagagggaatggtagaagtaactgacaaaaacaaggcacagtggacatttgaattagccttaaaggcccaggcatcaggttaggctctgttggaactctacctgattgccaggacaagcctcttagagatacagtgcctcagtttcctcatctcaaaaataactgaattgtagcagatgatttcctagggtccttctattctccaaatgggtttatcttggtttctgagcagtgttggactctaaggaacaaaatcattgttagtataacgtgttagtagttaataacagtcattctgttatttaaggttggaagagatgctgctattcatgtgtgggacacacaaactctaaaatgtttgtcgctgttgaaaggacaacatcagagaggagtgtgtgcacttgatttttcaggtaaggtccagagtgattgacacatggttctacgttgagagagagagagacacagagagagtatgccccgcgcatgcgcgcacgcgtgtgtgtgtatttaaacatgctcccacttagtcgttctgtttgtattgaagtacaagctctttgtatgccagctacccgctcttatactgagaatcatacataggaatacctcaccaaaaaatgtggcctttagattacacaccgcttcccatcttcctcattttctgtctcctaagtcactacccagagctcacactgtgttctgtatttgcttgagcaatttgaaatccagagcagctgttgctgttgacttagtcgcaaatgtctggcagtgactcagaacatcaatttcatctctccaaataagtgggagcacatcacttctgattgaaaatacaaagtactagagagaaggctgcaaattatctgcagagggccagtttacaacattggtattttggaaataacttttatatcgaaaaaatagaactgaagttttcatctccttaatttaaaatttgaacacagtatcataaaaaataactgatgaaagttaagttcctttagagtgagtgttctttaagttggcatttgagaatgagggcctatcacaaaaagtatttctacctagaaatttttaataattgcaactgtagaaattagatcaatagaaaaagaattctaaactttgtacagaatgctgattttataatttttttctaaattttattcaaatgcttaataagtataacgtgtaatattattaaattccatgactccacaagcctgattgttctcccctgtcccttcctctccccgttcaagccctcactctttcatctatgctatggtagtcatgctggtctctaattctatcccctcttcctcagtccatcccaccctcttctggagtctcccaaaagcatagttaccattgccaccacatggattccccttggttggctgactcattgtggagcccttgggacatccatggccttccatgatctggccttaaccttccttagcagcatttttaacccaccagcccattagtgctccttcacatctgtctaactgtggaggctacatgcactcttgcccttcttttggctgtgttctttgctcatgctgttctcatgtgtcttttcaagtcctcccgccctttaaggtcaagctggaagttttctcttccaactttacagggagaaataacctgtccttttttgtgcatcccttagccctttgttgtcattgctcttatggcacccattgctcttgtggcactccatgtggcacacagttacttgtgtcagcgtctcccaggcatttcacacacagtaaactacttggcagtagagcccatctgtctggtccccactgcacatgtcatattgctgtgcaaatagaagctactaaaaaaagtgaatgactaaatgaacaaatgaggttctgcttaatgcactttgtcttgcctttccctattactactagaattttacattataaaccacgtttgggtgaaaactaccttcattgcctgaccaatgcaacatggggcagtttttagtttttctaacaggcatgttctcacatactgtaaattactctacaaatctgagctgctgtatcattattagaagttattcagtgccttcagtgattatcaaattggtaaaaatcaaggttaaacagtttatactctacactggtgacatgtgaggtaggagaaggcataagtgtcaagggagagagaactccgcataccacctgccagctgaataacacagtcagtaattcactcaataaacagtgaatacaaagtccaaactcccggaagtgtgatggacatgcagttttaaaataggtgtgctgtgtgtcactgataaagcagtgaaacctaaaagaagctgtaattttagttcaaatacgattgtatttcaaagatgtggatgaattccttctgctttttgttctccatagttccactcctcagtggccaaactgcctttttcctaaaattaattttgctagcagacaaatatatgtatacttaatataagtaattaatatgctttagaagagtggtgaaatgcccgttaaagtagcaaaaataaataacaacagctaaatgtttacaacattattgggaatccaatatattcattcttttggcagcactgaaaattgactcaattctagcaaacaatctggcaatgtataacaaagctgtgattcaaaatgacaagtatgaagattgtattttatgcacatttcaatgtatcaagataaaagaaaaaattgaactcaaaataccatctatcactgactgcaaatgagaatgtgcatatgtgtattagcatataaataaagtggcaagaaatttagagtaatataaatagaatttaatcatttggttatttcctctatagagttgattaattttctattttttgaaatcgaaataattagctcgtgttattttaaatacctttggaagaagagattagcagatcaaagacattaactatgagatgagttggtagcaataagctggtacccagtaatgtggcctcttcatttcagatagctaacatttcttctgggcttattagttttatagaagaaagaacaagaaattaagtgagcttagaaacctttttcccataaggcagcccttcagatcagtgcctgggtagagaaatcagatactctggaggaggtgaggagcccgattctgtaactgcttctgattcccatcttgggcacataaattcccaaatatgaaatgttttgtgcataagaagggtatttcagtattttaacaatacagtctccattccccagataacaatcactgggaaagagcccatttttcagcaaatgtgttgtttttgcttatggaaattcacctttttgtcttacaggttaagtagtatgtcaatatataaatggtagaaaggaatctgatagttttagaaagtactaatactaaggactattgtggaaaaactttgactgatacgtgattcattaccataaatggttacatacagatgaattgtagtcattgactgggggttggggtgagggtgtggggacctgtggtgactcctgaaagtgtgagctgaggcctgtttggtttaatttctattgatagtctatgttttaataatatagtttgagtcttaaatccttgcaaccactttataggctgagaatggacatcctgaagtttggtggggtggcctgggtaaaagtgaacagtggccgatccaaaggcagaacccaggtccattgtgagagccaccaggcctgggtttgtcagcaggcaggaggcatgccaggagttctcctaggtgtcaggcctcctccagccgcttccctttgccgatgctagtgtgtacacttggcaagagtgtcatacctgggacactcagtgtgcaggctcactttctgctacctgtgccctccagtaagcttgtccatctgcccttcccaccctccactgtaactgtggagtggacatggtagtgcatagaggcccccatgtggaacagccccaagtgaagagagatcccgttctaaaacagcccagaaacacacacttacctgaagtatgaacaagggcaactaatgctaccatcctttggaaactgatagaaaagtgagtagctcaagtagaaatgttgaaagaggagactacgtagacctccttgtttaacggtgtaaacagggcactgacgtgacactcaacagttacgatttagctagtgctccatctgtgtgcctcaggactcctgtcgctgcccatctcttaggagttagctcttttggggggttttatggacacctactgatagcgtgcttgtctcttactagagaataaattgtcctggaaatataaagcaggcaaacaatgtgaaaactagataacaaataagcacagttatgtgtgaggatttagattgttcttgccacttttcgaaagcaaacaaaagacatttttagtcaaaaacatttcttgggcaaaatctgtaactgggctacaaggacaagaaggaatgaatttatattatctcagttgagaacctcttttaactcagtatttattactgtctaggggaaggggaaccatttttgttttgtgcttgccgtgaggaaagtgcttccatatgaatagaaaaccagattagaaatagaaaaggtcaaccacagaagtattttctagcctaaatatcaaccatataatttttttaaaagcttcgtagaataatactgatttccataagggcacatctaagacttgatttcattgtgttcagtagaaaacctacgcattttttatgagtcctgaatagagagaccaactcataattgtctgaataaaactttgtctaattcaccctttactactgacattaaatgccttcatattatttctggactatgtcacagacatccataattaatgcatgctgtgactgcaaagatgggaaaggacattacctaagagactaaaaacatggctaaaaataaaaaacttcaactaactggtcagagagtagatttccaaagctaagaccacggcttacagggaaagtgagaactgggaaagagtaaaaaggtagccaattttatttccaaactgtgtagtatatacacagaaatagcccacacccgcagaactcggggaagtcaccatcccaaaaaagaggtatggctgttgaggcacctctgggtttgcactgctgcttccattgctacccacaatcagaatacctttttttggtttagaaaggtggtataacagtgaggataagctgacagggccttgcagaaattctcctaaaataaaagctcacctcttaccccggcaaaatcagcttatccttaggccttcttcagatgacataaaactttattattttaaatgtatttgtgcttgcattccaagaagaacataactacacagatttcaaaagaaaacatgaaatatagtcaatgaatgcaacaagacattgaatatttgtacagtgtttttgaaatggacaatttctttaaaaatctgtttataattaacacataattgcaaatgtttacagggtagaatgtgacatttcagtacatgtatatattgtgtaaggatcaaatcagagtagctatcacatccatcacctcaaacatttatcatttctttgtggtgataacattcaagatcttcttttctagctattttgaaatatacactacattattagctatagtcaccttaatatgtaatataacaccagaacttactcttcctaactgtagctttgtactcactcttgactcatcatccaaaaaaaaatttttttttttttttgagacaaggtctcactgtgtcacccaggctggagtgcagtggcatgatcatggctcactgcagcctggacctcctgagctcaatcgatcctcccaactcagcctcccaagtatctgggactacagatgcacactaccatgcttagctaatttttttgtatttttgtagagagtgggtttcctcatgttgcccaggctgatcaccaactcctgggctcaagggattcacctgcctcagcctcccaaagtgttgggattacagatgtgggccactgcacctggccaaaatctttatagctatataacgtagtacattctatttcaatttataccatccacaggcatattctgtctttatcttcttcctcatcatcagtgtcaccagtatcatcaacattcattgaaaacttgattagtgtgatacttacaaaggaaatgtgataagattattaaaagtcttaaaaaaaagcttatgatattaaaaaaggagagagaaaacaccaataaaaataaaatcaagtgcagaggcatgccaacatagaaacaaccagaccatatcaagagatgtggaaaaagtaatgttggtaatgaataggaagtcattaccaattccttctcctaaatgctaaagagggaccttgcccaatttaaagcctggtaacatttaagcataaggggatatcattagttgtttttgaaagacgtagtttataataatcacctggtgatgatttagcccttaaggaaagtgttaacgtcttcatctaatactacagcctagtagcttgaaagggtcaggtaactttcaaatccttgcctcatacttcgtagtgatggagggttggagaggatttggtttgttaaaccagactttttctttctctgactctccttcatccagaaaaggaggagactaccatttccagttggttggaggagggtctcttgcataagcaagggccctcaaagcatgggcattggttagcaattgagatggggttgccagattaagccaacaaaattttaggaagctcaattaaatttgagtttcaggtaaataatttttgtcataagtgtattccatgcaaaataaggataaatatgtaatatacatataaatattgcatgggacatacttgtactaagaaattagttactgcttacctgaaatgccagtttaacaaggttttctatattttatctggcaaccctaatttggggtatactgcaggtctgcctttgaaaataccggttgggacctccgagtggactggcagaactggaagaggcaatttatcacagacctgtgttgctttatttaccctcatggctggcccttggtagtcagagaagagccctgatatactgatgcaggatgagcttgatcactcgtctcctagcaaccgcacagctagtggaagggagactgctgacccagagatggttctgtgttgaatctagccttgcaggaaggcagcaaaggaaaggctttttgactatacctcttcttttgtcttgaagggaaaaagcaaattaagtgtttttatttgaaatttaattgtgcattcagtatatttttaaaacaatttttgggaaaataacctaaatgtccaaattatagtaatcatggataattattattctcttagagaaataaattgtcctggaaatgtaaagcagacaagcgatgtgaaaactagacaataagcagttatacatagggatttacagtaatctattcttgccacttttctaaacaattataagtaatatttaatactaaaggaaaatgttcatgatataatagatgaagaaagataagataacctgttcattattattctggtattgttttttctaagcacatttgtgtaaagattggtaggatatatatcaaatgttagcctagaaattgggaagatttaaaaattttctgtatccatattttctaaatttcctataacaagtacactacatttgaaatagggaacataaaatttttaaattgtaaaatcatcttttgaaagaattttttaagttaaatttagtttctataatgttcctaatttggagaattaactgaacccagtttttagagctgaaaatggtctcaggatcacaaagccaagtggtacctcaagttaaatgtcatgagatttgtttgtcacaaaatagacatagtttttgtagcttacctgagagtctccctctagctctgtgtctcagaatgtcaggtcggcagtttacttcggcagcccgttatgcattaggaagctcggctatctctagtcatgcatttcattcagcgaggtccatttagtatatgataccccttatgtattaaaatataattgtacatgtttatagagtatagtgtgatgtttcagtacatgtatacattgtataatcaagtcagggcagctatcacatccatcacctcaaatatttatcagttcttaagatcagttacttattcctctttacagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaatgatgtcctttctgtcttgcgatataaaatcattttgaagttaatagccttgaaccccaatattcactttttaaagtaatattttcctctacaatattaaataggaaaaaagttttgtggggatttaatgaatgaagatttataaattgctagagacctggaggagcagcagatggaggcatgaggactccaactgaccatcttcggagaaaaagggaagcttttctgatgactgctgttgagattgaattcttggcaacaaatgacagctcataaatctgcctgcccaagtggtttttcttctggtctttgtttctagtattcctcactgtcattccactcccttctagtagtactcagattcagcttctcatcagaactctgttccccccagactaaaatacagaatttaagtttaatatttctgataatataccatctgcctttacagataatttcagggaaagcacatttctggatttcaaaagcaacagaaatgcaattttcctgctagaaaaccctctgcagctatgggtggctcaccagttttatgcccgaaacattaatagaaatggaagaaagaaatatttcttaatattaaaatagtatatattttatatacttgttggatagtgttactgcctctatttaacacaaagttgacttaacaccattatgttaataacacaattcatatttggaattgctcccaagccttatgacacattcccaaaacaggatacctgcagaattgcccaggagaacattttggattgacattagccagtgctgtttccaagcaggaatatcaaggattaaagttctttggaagaacagtagattttacagtaaaaagtaaataaaagttacttaaatatctatttgcataatattaacaatgatacatatttacataaatacataagaaatttagacaaataaataaagcttatatgtatggccttagagtgcttaagtagatagaaacttttaaaaacaggaggccgggcatggtggctcacgtctgtaatcccagcactttgtgaggctgaggtgggcggatctcctaaggtcaggagttcgagaccagcctggccaacatggtgaaaccccgtctttactaaaaatataaaaattagccaggcgtggtggcgggcgcctgtaatcctagctactcaggaggcaggaaaatcgcttgaacctgggaggcagaggttgcagtgagccacaatttagccactgcactccagcctgggtgacagagtgagactccgtcccaaaaaaaaaaaaaaaaaaaaaatttaaacaggggcatgatagaagcgacaacgaagtaatccttaacggaatgataccttgcttccagggtcatctaagctcccaagagggcctaattcacagagaagctgattcagtcctacccctcactttacacttctgtgtctcgatcactgccagcctcatttatagagcaaggctgaacaattaacctgcttctggctggctgtgctgttttggcaagggtgattgttctgtaccactcatcgcccaggaagtgagatttctccacagaggaggagcatggttggtagctgtggtggcatcgtcagctgtgctgctggtggctgtgctgacgtgtgccagctgtgcaaccaggcactcagaagttgctcctcccctgattggtgagaatattttaaatgaacctactctttagcagctcacagaaactagagaaattcagaattggaccatagagatcttatttacaagatactcaagattttattttcaagatctctgtgagacgatccgatctgtttaaacaatttccccgcatgcaatctttgctaatttttatgagtgatttcggttacctccattacaaatgaattttttagtcttttttttttttttttccctaaagatcattccaattttagtctagtatacaagtatcccatttaagaaccaaggctgatctcttatagaagtagttacagggtgtaacatcactgtcaatcagggcagaataatgcaatgattaatcaggtacatctgtgctcctttatttgtgcttgtgttactctggtagtgtgactaggggaacaatgaataggagggatcttggacaaaaaagaattatcaacaagaacacttcccaggctaatctgaaagttttgctgctagaaagcttagggacaaaggccgggcgcggtagctcacgcccgtaatcccagcactttgggagaccaaggcgtgcggatcacgaggtcaggagatggagaccatcctggctaacagggtgaaaccccgtctctactaaaaatacaaaaaattagccaggcctggtggcgggcgcctgtagtcccagctacttgggaggctgaggcaggagaacggcgtgaacccgggaggcggagcttgcagtgagccgagatcacggcactgcactccagcctaggcggcagagccagactccgtctcaaaaaaaaaaaaaaaaagaaagcttagggacacactaagcttatgcatatggcaggcgtatcgaacttccaagtaagcacttctgtattagcttcatcgcttgatctattttaggtccctacctttacatgcatttaatgactatgatagagtctcccgcataccatatgggccccttttctttttcactttgttttttaaaataacacttattctttcctctgtttttcaaataatatatgatcattatagaaaaattagcagggaaaagcacttaataaaaggaaaatcatctataattccactacccagatgtagccatggttaacattttagcatatatcttttagtgtgtatttttctagtatttgtattcatttttatttacatgtggagtattgtacatatgctctataactggtttttttcactcactaatacatcatctcactgtgttctaatttgttacctgtcttgttctatattattctatattttcagccaatttaaattttttttggagttagtatatgtatcaaacattcatcagtcttcctgttaaaggctactgccacagaaagggagaacaaaattacacacaggactgggcctctatgcaaacagagttctgaatggacagtatggaaaccaagtcacccagtgtgcagttgcccttggcctctggaagaggctccttccttcgtgcttgctggtgggtttatatggccctatgcggtgaattccttgtgatggggcgtgaggaatcatccagtgttaggacagcagcacagtgtgtaagttcttattctcgccatctaagatctgacaaactctttgtattttgttttgcttacacatacacacatgcacatgtgtgcacaaacacacctacacttgcaggcaacttccctacaagtttaacaagtgtgtataagaaaaatgacaggtatgcagtgtgttctttatttatatattgacattagctaaacatttacatgccatcattagccactttataactagccacaacagaaataaccttggtgtttttatgacatagagtaggacaacaaaagctctcacccaaactcaaagtgctttttccgttttctcactcaacaacaatctgcacagagacttctgtgaccaaacttgtggggatttctccccaccagcaagcaaacaattctgtttgctgagtattctctagttccgttctattctgacactgtctacctggaggtagcctcagatgccacaggttgagggctcagtttctgagaccgttcccctcatcccaccttgggttcgattaatttgctggagttgctcagagaactcggacatacttacttcatttgccaggttattacaaaggttatggttgggaagctatatagggcaaggcacgtaggaaggggcacagagcttccatggcctccctgggtgcacctccctccagggatctccttgtgttcagctctctagaagttctccaaaccctgtgctttggagtttttactggaggcttcattacataggcatgattggtttaccaactggcgatgggtgagcaacttatcttttgatccctctcccttccctgaaggtcaggaatggggctgcaagtcccaatcctctactactgctttggtctttctggtgacccatcctgaagctacctctgggctggcggccatcaagtcaatcatgagcatacaagaagacctccatggagatcctaaggattgtaggagtagtaggtcaggaaatggagggggagaattgaagaccacatatgtattttgtaatatcacaatggcactaagaaatcagatgtaaactaaaaagttctcacaaaaaagatttttgtaaatgtttggcattgtataaatacaaggaaacaatcttttatctctaggaaatataattttctgtacttgttattttcattttggttttctctagtctctctaaagtatatattaatgattttgtatctagggagattttcctccaatcaagaaatcattgggctgggcatgggggctcatgcctataatcccagcactctgggaggctgaggcaggtggatcacttgaggtcaggagttgcagatcagcccggcccccgtctctactaaaaatacaaaaaattacccgggcatgatggtgctgtagtcccagctgcttgggaggctgaggcatgagactcatctgagcccgggaggcagaggttgcagtgagcccagattgcgccactgcactccagcctgagtgacagagtgagatgctgtctcaaaaaaaacctggcacggtggctcacgcctgtaatcccagcactttgggaggttgaggcgggcggatcacctcaggtcaggagtttgagaccagcctgaccaacatggtaaaaccaccatctctactaaaaatataaaaaattagccaggcatggtggcacatgcctgtaatcccacctactcaggaggctgagacaggagaatcacttgaacccgggaggcggaggttgtagtgagccgagatcatgccactgcattccagcctgggcaacaagaacgaaactctgtctcaaaaaaaaaaaaattttttttggatgcttaatgtttttatggttatctggttgatttcttctcttggtgttaaacacatttcgtctttagatctttttctcccctaattgttaacgatatgtccagtaatgtatcctagctccaatatccatattcactttttgattttctttttttcttttttgatggagtcttgctctttctcccaggccagagtgcagtggcgctatctcggctcactgcaagctccacctcccaggttcacgccattctcttgcctcagcctcctgagtagctgggactacaggcgccagccaccgcgcccggctaattttttgtatttttagtagagatggggtttcaccgtgttagccaggatggtctcgatctcctgacctcgtgatccccctgcctcggcctcccaaagtgctgagattacaggcgtgagccaccacgtccagcccactttttgattttcaaagagtcagagccccaaaattccatctcttccttgcctctcatcgtagggttcacattcatgtagccataatggatcaagagacattctattctttttattgtggaaaatttcaaagttatgccaaagtagagggaatagcataatgaaccttctgtacccatcacccaactgtgacaatgatcagcatactacacattgcacaaatgtttccttttttttttttttaaccttcttttttttttttttttttttcttgagatggtgtcttgctgtgtcacccaggctggagtgcagtggcgtgatcttggcccactgcaacctctgcctcctgggttcaagtgattctcctgtctcagcctcctgagtagctgggattacaggtgcctgccaccacgcctggctaattttttgtatttttagtagagatggggtttcacaatgttggccaggctggtctctaactcctgacctcctcaggtgatccgcccacctcagccccccagagtgttgggattacaggtgtgcgccaccgcgtctggcctctttctttcttctattattcagcttcatcttttacatttagatctggtgagaatggaaaatggtgcagcaacttggaaaacattagtgcctcaaaatgttaaacacaggcctccaacttctccacattctggccaacacttgttattgtctgtcatttttattatagccacctcatcagtgtgaagtggtatctcattatggttttcctaatagctaatgatgttgagcatgttttcctgtgctgactgggtatattttctttgtagaatagagtgatttgtctttttattattgagttttaagagttttaatatattttgaatataggtcccttatcagatatatgatttgcaaataatttcacccatgttcaagtttttaggcaagaatgctttataggtacttcctgtcacatcagaaaagataaaatcggtggtataccagagagtagggaggcagtaggcatggtccttcccagatgcaagcaataggggtatattatctgtagagaatttgaaaataactaaaagccatactgctttttattattcccattatctggcaattctaaacaatgttagtgatggaattccttccctccaggatggaccacttcccctgcaccacccttttgtacactactgcccagaacatctaatttttctgctgtcagtaatactcagctcagttggtgggttctgggagcattgacctgatcctttcattatacagctccccatcaccacattttctaatggttgtagcatcagctgacaaccttgggctaaattggttacttagttcagggttcaaagtggcaattttctaattttatcattcattcttcacgttagctagaattattttataaacaattttccctcgtgaaccatttggtttctctgaaatataattctcacagaaagtgattctttaaatgttagggttatttgagttttgtctataacttgctgatttttttcccagtttgtcattcatcctttgaatttgctgtggtgtttttcatcaagcaaaaggtttatatttttatgtggttaaatttattaatcttttattgctttaagatttttgtatttagaaaaatactgcccattctcacattaaaaagaaatcacctattcttctaatgttctatggcttcatcttttatatttaagtctctaaatagtttagaatctatcctagtatctgaggaacaggtccagctttctgttttttccatatggctaccaaggtgttccattttttccctttttaaatagattttatattttagagtggttttagattgacagcaaaattgagcagaaagtagagagagttcccattacctcctgcctcctcatatgcacagcctcccctactatcaccctcctgcactagacggtacatttgttacaattcatgaacctaccttgacatatcattatcacccgaagtccgcagtttatattagcattcacttgttttgtacattctgcgagttttgacaaatgtatattgacacatatttttcatgtagcgttaccaagctagcaatgggcttgctgcccaaaaagcatagacgccaatactatgccaccagcttttgtgaaaagaaagactttattgcagtttgacgggcaaggagacaggaggcagtgctcaaatatctctctcgagctgggggctggggcaggattcatagcagagggtaatgaggcatgatctgattggatcttataatgcagtgtggccgggagacatgataggactggatcatgccatgaggtgtgtagttcttaatttggtccctgttccttgggccaagcactaaggttccacccatggttgcatgcttggttcatctgggcatgatcaggtgatgtaacttgcaacctgggttacatgataactgaaaaacaactcaccattgtattatataaagttgaaccagattgggctgattctgcagttacaacagtatattcaggagagtttcactgccctaaaagttctttgtgttctgcctatttatcctttcatccctcctccctcctctgtatactgtggcaaccactaattttttacccatgttagtagtttttaccttttccagaatgtcatataattggaactatatagtatgtagtcttttctgattggcttcttttacttaatgatatatatttacatttcttccatgtgttttcatgatgtggtagttcatttctttttggtgctgaataatatccattgtctggatgtaccacagtttgtttacccattcacctgctgaaggacatctatgttgctgccacattttgacaattatgaagctgctataaatatccatgtgcaggtttctgtgtggacataagttttcagcttatttaggcaaatatcaaggaatgtaattgctggtcgtatggtaagaatatgcttagttttgtgagaaattgccaaactgtctttcaaaatagctgtatcattttgcattcccaccagcaattaacaagagttcttagcactccacagactagccagcatttggcatcaaacaccatttattttaaaagttcatctttctcttgctatttatgtaaaaccttgtctttgttatacactacatttttatattcatttgtgtctgtttcaagattttctgttttgccatttgtcagtcaactcatacacaggtactatactgttttaattatggagcctttatagattgttttaatacctaggagagctactctctgcactctgcttttctgtttccgttttcctggtcattcctgctggcttattcttccatgagagctttaaaatcaaattgtctaactccagattaaacacacacacaccccgtggtctttttattggaactaagttgaatttataaactaagggataactgctatctttaggattgagttttcctttccaagaacatgggatatagttctgttttttaaagtctgcctttttaatcttacttatcaggtctttttttctctcttcacttttatgttacatgtatctcgttgagtttatgccttgttatttttattgtttataaatagagtcctctcctccattatatttttcaaccagtcactgtatatacaaaggttattgatttggtattcaattttatatactgtacctttactaaaatgtcttatttgtagtcattttaaaatttcctttttaattttttagacatatatcctttgcaaatatgaatagttttagctcttccattccagctcttgtgccttttaaaatctcctctagttgcattagtttatatgttcaatacgatgttaaatggtagtggtaattatcctgactctattgggaatgccattaagtaacagtccttggagtgtgcacacacaaatatgacgaataagctattccagtgtgttctatctttaaagaaaagataatgacacatagcatgtttggagagccagcctatatgtagttagcttgaataaatctgggtttctcaatgacaaagtacagggaaatacaaatgtctaaatgacaagtctgaagcatcctttaatttctactgtattgggtgttgagtggtttattttttaaatcatgggtgactgttaggtttttgtcaaataccttttcagcatctgaaaatgataatatgatttttctctttacatctattaatatgatcaattgtattacttgattccttaatattgagccacccttgtgtttggtcctaatgtattgtttttaatatgctttcagattctgtttgctaatatttatgatgtttgtctctatattcgtaaggcagatcggtcagtcatgttcttctttttaattgctttttttacattattaaaattatgtcctaatatatcaaagaccatcaaatagtccctctcatgctgtgagatgccaagtctacagcccaggtctacaatggaactttgcacttatgtttgtccttctgccccttaggttataaacctacctctctgtgcagcattccaaagtgcctcgaatcaatagaagacatcctttctctttccatagctgtgggtccagggcttcaacttctaaacaatatgtttccagctgaaaacccatttaacccagagcaatgctttccacagcaagagtgattcatgtgaagcttttcgttaatactctctttcctcctgcacaagaggaggaaaagagaagtcaatactatctctttccttctgcacatccccacaattacttgcaaccccacagtggtggcattaattttatcttatggagacattacaatatgttttaaatatttcattactttgcttaaagtataagtaaataaactttggcagcaatattaggataagaagaaagggttcaaacatgcaaagaaaagccaaagctcgttattttaatgtagatgcccgtgtggattttaaaccattttctaatttaatggtcctgttagatgtgcttaaaattagaccaaatgcatgcttttaataaaactgttactgcttccatccaaactagaatcttatttcctatttgtctcttacagaggacataaagataagatatttgtggtaaagtgtaacccacaccatgttgacaaactggttacagttgggataaaacacatcaaattctggcaacaagcaggtactgtcgtttgggtttatcatttatgtgattgagagctttaccctagctggaaagaaaaacaaaacaaactgttgctactacctcgcttgtctctgcaatctaaaataaaaatgtgcctaaaaaaattatctcccaagttcgcttagaacgcttgaagcttagaacactctatatgacgctatgcatattcatcaatacctagaaagctttggaaaatgttctgctgtgaaaataatcatttttatatttagtcatctgttctgaaagcagtaattatgttagactactgcacaggaaataaaataatcattttggttgagtgaataaaattttatctatttggatggttcctttatttatctattactgaatttaaacctgaattaaaccctgagtctgcccacaaataggtggtccaataaatattggtggatttaatgttgataataatgatgagtaaataagcatgagaaaacatagaggatatctcattcttctcactaataagtcagacttaatacaattgaatctgaattcttagtatcagctttggtgccaagccctaacttattatgcacaaaatgtgaataaggttctgttccagtgcattttgcttttaaaagaaggtaatgccacccagtatgtctggagagccagcctgtgtgtagctgtcttgaataaagctgggtttctcagtgacagggagtgtggggaaatgtgaatgtgtaagggacaaatctaatggcttgtcccgtatactaccttttcctacaaaacaattcttttttctcaccccaaaatagctgttataaataagcagagcatatataacatgcttatattttacatttacagtcagtactatttttatcgtttttggtcagcattcatgaagactttgcttgctccttcaggcacttagtcactctttctcttggctgacacagaacttgtgctgagcctcagttagacgcatgtcttggactgagatgcatattgattgctctctccagccagactctgagttccttgaatacaggaaccctcttttcatcttcatatcccaacagtgagcgctgcacttaccacatgtagggattcagtaaacactgagttaatgaataaatgagaaatattcttagaatatttttgttcatgatgttctctgtcacttttagacatctttacataaatacctaatgagagacaccaggtttctcatggaagtagtccttctacatgcttataggaagtgccagattttataaagtaataactgttcttggtccactctaggtgggggcttcacttctaaaagaggaacttttggaagcgttggaaaattggaaacaatgatgtgtgtttcttacggacgaatggaagatctagtgttctcaggagcagctactggagatatttttatttggaaagacattctactactgaagacagtgaaagctcatgatgggcctgtgtttgctatgtatgcactggataaggtatggcctgtgtatcagcattcattttcctcatcagccttctaaaattataaggtagtcttaggatggcccaagaggatgcctgtatctaaaacaggcctgtctgaattaggaagtagttgtcataaagctcagtcaagagacaatagggaggaaagcaaagatatttttataatttcgtttacagttgtttctttatatgcaacttctctgcactttttccacacatgctcttcctggcgcccactcatgagagtcccttaagaagtgccaggataaatgtggacacttagcagcagaagagtcctgagaaatacttcagcattgtcttcctccttggtgacacaatgggcagagacctgaaagtaccaaatggttacattattgttccagacgtccatttgctacgataaatttgcatccataaccaacttgctcctgtgtagaaaggctcagctttaacaagagtgttagagtgaaggctgttcattggccatattacaattcaagctcatcataattgccctggtctgtctacttgccttgcagtgtccctctacaaagattacacttaccttctctcagtctgtttttgctgctgtaacagaatttctgagactaggtactttataatgaacagaagtttattggctcacagttctggaggctgggaagtccaagagtaaggggctgcaacagggaagggccttcttgctgtgttacccaatggctgaagggccaataagagtgggagggtccgaaatcatcctttagtaatgaacccactcctacaataatggcattaatccattcatgagggcagacccctcatggtctagtcaactctgaaagttcccacatcttagtactgttacagaggcagttaaatttcaacatgagttttggagggggctaatatttaaaccatagcaccttcagtgttttaaaacactttattcaatcaacttgccagcaaatatcaacttcttttcagttatttccaggttgctggtagtaccacttcatctgtgccctctgacctccagttgaagccacctactactcctaacccatgtctcaattttcttttacctgtccttaggcaaatgtgttgattctactacaaaagtaggttcttgttaggtatgcaactgtaacggttgttttgctggcaaaggtgttgttttgttttgttttgtttttttattggtacatatgtttttggttaaactgcaagtattagaaaagattaaagaagaagaaagaatttctgtaggcccagaagtagatatggtgtaacttgtttaagctcttgttgtttggtaaattaagctgcaaaatcatgagaaaagacaaggatatcacaatataatatattgcattttaatttaatttggggattgaattttcctgggtacaaattctatataagaataaggatatttagtgttatacacttggaaatattatttctttgtaaacttcataaaaatgcattaaattaaaagttgctaagaaagcagtgaattactcagcttttttcttagaaaaaaaaaaaaacctctaagaacagttggtatatataataaattaccagaaaggaaaactagtacagccaaaaaattataagcttagaacaggaataaagatcactgttcagtaaaaaatatccaatatgttaagctttttactttccaggtttttgtaaaaattaatctggattttaattatggaaattgtgtctattgaatgaaataggatcgtttcattatataaagtacctaagctactcttaataaataatgatgttttcttctggacatgacttttatttttaaatgtttaacaataattttaaactgtgatgttaacttcaatccatttggtcagagtatgtgagataccagaaactctgctaggttttgaggctggttccattctgtaggaaccacattctggttgggagactgggcacaagcagagccatccttgatcagtgggccagctgccaaccattgttctgaggagagtgcagtggacacatgctgagaacgtgcttaatcttgcttagggaagtatgggagaaatgctcccaaaaaatattattcgaacattgttatcaccagagttttccatctcatatatttaggaaggtagcatccacaaagcttccttacctgcggggaatcctcctggggccaagtgggtaattggtcattttgatgtgtatataatacctctcatgtgtgccttcacagggctttgtaacaggtggaaaggacggcatcgtggagctctgggatgatatgtttgaaagatgtttgaagacttatgccattaaaagatcagcattgtcgactagctcaaaaggtgccactcccaaacatgtaatagagatctttgtattcatagggatggagaagattgtactaaagtttttagaaaactattagcaaatcaattttctccctcttccatgtttagaactctcttcctctggtagaaatgtcaaggctgactgcctagtacctagttctttggagctataaaaattgaatttatactaataagcagttgtttttgttattgtgttaaatataccatccccttccccaggcttgcttttggaagataacccttcaattcgtgccatcactttgggacatggacatatcctggtgggaacaaaaaatggagagattctggaaattgataagagtggcccaatgacactgcttgttcaggtactgtttgtatgtattctaaactgcagttcacatcaaggctgggactagagtgaggcaaagttgatgcttaggttgcaaaacttaaggaggcactcactctcagggttgcacaagagttgaactagttacctattgctgtgtaacaaattgccacaagcttagcagcttaaaacaacacacatttattttctcacagtgtctgtggatcaggaatctgagcacagcttaactggatcttctgcttagtgttttataaggttgcaataaaggccagggttatggtctcatctgaggctaaactggggaagatttttccaagctcactcatgttgttggcagaattaagttgcttgtaagtgtaggactaaaggcttttttttttcttgctggctgttggccagaggccattttcagctcccagaggctgcccacagttccttgccacatagggtttcccaacattgctgctttctcaaagccaaaaacagaggggaaaaaaatagatactacaattttatgttacataattatgtcatcacatatgtggaatcataacattccattgcctttgccatatgctgttggttagaaacaagtcacaggtcataccacactcaaagggaggtgattatgcaagagtgtgaaaacacaagaggagtatgagggtcaccgtcactggccaccctctggccaccagttattcatgtccctaccacatacagaatcctttacctccacctccaaggtccccaagagccttatcacattacaggatctgctcaaagtccagaatctcattatctaaattgggtccaggtgtggaagaagtgccttagatgtaagtcctgtcaatctgtccgtccataaaatgaacaagacaaattacctgctccccacatgccagatgcacctgtgcccctttggaatgtgggcctcactatagtctcagccttggtccacataagcaaattgcatcctccttagtccctgtcttccctcaaaagtcatatttaggtaaaattgaactaaaataaatgtaacagaaccttttaggagccaagaaatgataaaatctcacctcaaggatggggatgtggtaggatgtggaggtgcgttaggtagtcctgcccagtttggtgatggataagaccatatttaggtggaagaggcatggtgaggggtgaaggatgtgtgttcagaagttggagagaaaagaaaatgcactgatcatatgagcagtcagaacttccaagattccagtgcaggagcttcccctccttgccttgatctctgagtgattgatgcctgcaggcttgctgtattacgagtgaatccccaaatcccactgagagggtccctctgacttactgtatcatggaaacacatgtgcatatacactatggctcaggacactgcaaggctttaaaaacacaggtgcccaaatcccaccctggatatcctgaacaagtctgtgtttttaaaagaaaaaatctatgttaaaaacaaacctcgaaagctctgcagctggtcgtgccttgcagccaggctagagaactaggctggagatgcatccttgaggcaatgaggtctttgttctccagctgttcttgcttttgttgttttcttccaaactaaatctttttttttctggccataacttctaatttaattttactgaaaagtatttatttactttttaatctccaaatgtttgagaatgtaaattgtttccatgtatgctatattgctagatattttagaagatttatgccccaatatgatttaaataatactgtaagatctaaactttgttttctctcttattttgttacacttgaggtagtttggtttaaatatgttttatgcttgaccaaggcttttcacttcttaattctctacaattctattctttcctatgtttgtttctattgctctaataagaaaaataaccacagcaatcatatattgagcacctactctgtgtcaggcaataccgttgtacgacatttgtctcatctccacaacagattggctctgttacattgttttatagatgagggacctaaagcccagaaaattacccacagtcacatgctaagaactgcagagctgggattccaaccaaggtttgccagagcccttgttcacctcaccaggctgttccccacatctcttagcttggacacttcaggaaagcccctgagctatggggtggctggttgagctgctggaagcttcagaccagatgttagttaccatctttgccacctacatgtgtaccattctctcccttttttttttttcagcatctttttttcgtcttctgctctctcatttgctatttcctcttaggtggatctcattatttcagttcagtcaatgtttgttgggctcctgcccaggtctgctctgtgctgtgtatatgtgcagtggaataagggcttcctgcttgcccaggaccgtgtcacagtcctgttctgagagatgatagagacagcaagggaaagtgaaggaactgtagaggcagtgtgagtgagacgatgggctgtcctgccggaagaagattttagatccactttgccggttttggtggcacggcaatccaatcacagttggaatagactgcttattttttaagagaaaataaggttgggggaggggagaatggcaggtgatgggttgtggcatttcccgtcatgtgtgctttgaagcagtcagctcgcagttgtacagctgtttatgatcagctttgtgggtgatcagcagcaaagcaggatcctaagcccatttccttgagccattcaaggtccttcaagcctgcctcgcttactgtccgatcctgtgttacacggggattaaaataaacagattaaggaaatacaattttgatgtcaatataaggcagtggtttaaaaggatctctgggtcccacaatcttgttcttaactaaaatacacaaaggggctcagtctatagaagagcttcaagcagagtcagtctgggaagatgtgaggttgacccctgagctgtaccctgactgtgactctggggctgggaggcttccaaagagaaggctagaaaaccggggatgtagggtgtcctcaaatccaataaattcaaaaacaatgtctgtatccttcagccctcattttctcatatttgaatgtcagttgtatttggaactttacatcttctgccaaattactgttttgctcaaatagcttctcagttaaattggaatcatccaatttctctttggaaagccacctgttccccaaagcattccagctacaaacacctttcagatgcctgtgtgtgggcttcctttttgctttactaagcaaagcctttttgtaattagccattaaaaagccaaaattcagtaaacagttaatctggtctgttttattgctctgtagcactaatctttacacactgcattatagagtgaaaaattatgagaatcaaattcattttctccctgttaagtgttcgttataaaaaaatactgctttctcttagttattattctaagccagccaagtgtgtttgtgataagatacagatacatggaattggtccagtgcttattaagcacctttcagtttttgatgttcattgttggcacatggacagaccaatttgtgaacagacgcagaacctgggctacaccgaggacgcttgaaatgaaaatttagcttcctttacttctgctctgccgaatgctacacattcaaaggactaaaattgcataaataattagaatattgctcttcaatttcactgacatgaatgggtcgtacctgcatcttttagaatatgatttaactgaaggaagtggtttgtgtccttgtgattaagctgctttactaggagggtacatatatactatgtttatttagtatgaaacaacagaaaagcaggcatttcaccatttacctggatgtttctaaatggaaagatgtttggcatcatataaacaaaaccaataagcaatgagttcatgttttgctttgcaaatgaatgatttagcatcgtgtaggtctagctgtagattcaagtttaaatgaaaaaattatttcgggtgatgattttggttcaaggaagctcaaagtgtgtttattcctatttgtgcttttttgtggtactcttggactgaatatgtagcaccaggctaaagaagggctagccaaacagcataagtagagtttatgttgccccttttcctctcccacaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtacataacaccaccttacacatctgtcagagtatttacaagtaacagaatgtgtcatatttattcactcagttaatatttactgagggcacgtgttatatgcccataaatatgctgggcaatgagaattttatattggttgctacagtcataactaagcacatgtagaattatgccagaaggctggcctaatccagctccatttttcacttcattttccttgcactgcacagatatttgccacctgggggcaatatgtccttcctcttctcattgagagctgtgggagtcaattgaaattcatcagcttttaaagaatgctatttattttgtaacagtctccagaacttattttatgacttgaaaacaaacatcaattatatagaaatataatacttaagaaatgagtaaatatgtcttgaacacctaaatgcactagaactatgaggtgtactgagaggtacaaattcagcaaacatttattaagtagcttctgtgtggcaggcacaggggatcccatgatgaatggtcccatctctagtgtcagagatagacaggacttgaacagagtctcagcaacatatccattcaaattgggtaattcgaggagagtctttaaaatgggactatttatataaagggatggggaaggtatgaggaaatgaccagggatagtgcagcactatgcagctagtaatggcggctgctctcactggccctgggcttgaagggacaggaggagaggacaattgctgcaaccttgaatatgagagccacatgagatggcagcctgagagaagccacgactgatagcaggggactctgccagcatgcagtgaccctgcgggaggcagccagggaaataaatggcccggcctccctattcttcctccatctctctaatttcccaccagtgctccccgttggccaaagtcaacctgaaaccagaggacaagggagcccattgatgctctccatgcagaccagcttcaggcacagagcagggtggacaagggcaaaaaggggatgtgaaaggacaaactaaagatatttggcacaaagtaccctggagcctcagaggacatctactgcttggaaatgcttcatcagagaggtgacgagctgaggcttgaaggatctgtaaaagttcttaagagggaaggatgaaattgaggtctgaccctaaaatatttgtactgagtaattttataagcagacatgaggattgtattctagggtaataaaatgaagaaaggtgtcaaaacagtagtaacaatagtgatggtggctaatatggctgagccaacaactatgccagctctttccatgtagtctttgtaggaaccccatgagtaaggctattattattgccacttacaaatcagaaaactgaggcacaggaagcttaattagtttgcacatttagtaggtaatggaaccaaattcaaacccatgcagtgtgactgtgagaacacacctgtggccactgcttaacactatttccctctgccgtgttgcctgtctttacactaggctcctggggattggtaaatggtggaggcaggatttcccaaatctaagtccaaagcccatgctcgtaatcactacaggctagaatcattttggctactagtttatatcgggggaatgataggccaagtcctcactgtgaaggacttgaatgtcagtgaatggactttattctctaagttaaaaattagttgaacaactattgacccatcttagataggataaccattcaacccagtttacccctgttgttctggtataattattaatagctttccttttcactctcaaacgtgtcttggtctgtacgatagattgtgattaacctaatcttgatgatgctcttcaagggcaggcttgtattttcattgtctcagtactggcacgtcagttttgagcatgaacacagctttcagcataccatgaacagaggagttggtaaagaggctcggtattaaatgccctggcacaaggccacctggctgtcctatccctggggtgtgcttacaacgctcgacaataagaatggtggcagagggtaggcatgttcttgaatcagtttccttttagacatacctttgcaaagtccatgctcctgattcagaaatgtctttgtgaccctacaaaggagtagagaacatggttcatggagcaccatcaccctagtgccaattagttttccagaaaccccttgggagaatgttcagattccattcttcgcgtgacagaagaggcaagaacaacatctttcacctctagagttatacattacaatccgtggatcagagaattggagcaactaaaagaatgaggtcctctaaagcaagttgtatgtaaggcttaatatttaaaaaaaatggtttctggaaattttattatagaactcctattcttaaatattacctcttttcttcgaagcaaagatactggtcctattaaccctatactccttttctccatttaccccacttattttttggaaaccccaggtatttaaatactcataaatgaatgaataaacctcatggaagttgaaaatgtatttttgatattatgatctttttccttggacttggggagaagagatacttaattttattttcttgagacagggtctccctctgtcatccagtctggagtgccatggcatgatcactgctcactgcaccctccacctccaaagctcaagtgatccttccaccttgcctcctgagtagttggaattacaggcatgtgccactattcctggctaatttttgtattttttgtagagatgggattttgctgcgttgcccaggctggtcttgaactccagggctcaagcaatccacctgccttggcctcccaaggtgctgggattacaggcataagccactgcacctagcttatttctttactttttgtacagggtgggtttcgcctctacaaaaaataacttttcaactaatttttaacctacggaatgtggcccagactggtctcgaactcctgggctcaagagttccacctgcctcgaccttccaaagtgctgggattacaggcatgagctgctgcgcccagacaagaggtgtcttaaattaggaagttttagttctcacaagtgtagtgtcaatttaaaggcagtcacgtgtccatacataatgcacatcatcagatttcttcatcttttcatgtggtttgcttgacagtgaagttttggataataagtgttttttgtggattcttctgtaggtggaagatgctgtgccttttcccctgatgggaaagccttagcggttggcttgaacgatgggagtttcctggtggtaaatgctgacactgttgaagacatggtctctttccatcacagaaaagaaatgatctctgatattaagttttcaaaaggtgaagatgacagcagatactttttaaaatagcacagtcttgggacaaaaaattacaagaatgaactatttcaaatgtttctttgaccattttcccacttttaaaatactaagttcctggaagtaaattcctatataaaatgcttcgatgttaaccccacatttttcttaacagatacgggaaaataccttgccgtggcatcccatgataactttgtggatatttacaacgtacttacaagcaaaagggttggcatctgtaaaggtgcttctagttatattacacacattgactgggactctagaggtaaagtatgttgtggcttttaaaatagaatttctgtgtttaaaaaatgtccatttatgcattgtttctagagagaatggcagttgagtgttagaaatgggaaaggggaatcccacaacaatataaacgactgtaattttacaacccagaggcagctgctgctaacattttgaatactttttccatctttttacgcttaggatgattattgtcactattgattcaagccattgagttttaagacagttaaagatacatgatgccttttgttatcatagcaagccaccacctcacctttagttgggagtgctttctccttgtcttgggtcccctcatcctcctcctggctggtttcccttttccacccaaagctccacctcttggagaaccgcccaaaaaggctcaagcaaatttcctcctccagcagaggtagaaatctacattcagcctgcctaaaatttctctgctctataaaactcccaacctactcctacctcctccaagtcatgcccacaaatgccatgaggatttgtctatttaataactctagcttttatggtgttgcatagtcttaagctagcaaatgtggaggctctggaagtgagtaagacatggtttctgctccctgtggagtttataattgagtgagggagatacttatccataaataatacaagagcacaaaatgggtaccgtgtgagtaagcagtggtgagtcacaagggaagtggtgagcagggactccgaatgggccacggcagcattcagtacccagggtggaacattgcactatagggtgagtcactcgtaaatcctatcctcaagactcggctgatgttgagagtctggagcgggtacttgggaatggacagcattcccaccttcagagacgttgtagtccactgtggtagagaagcaccaagcccaatgtatgctctgagggaaagctccttggaggtaatccatggagcctctgtagaagggagtgacctttgaggttgatcttgagagataaggagaaatccaccagatagcgctatcaaggaagagccattccaggcaaaaggaatatggcatatgaagagtgaaggtgggaagaaccagggggtgatgaagaaatagaagtgctcagtggctgagggtgtgaagggaggggaatgtggagacacaggctgggatagagcagaactttcatgctgaactgtgtacttgtaggcactatgtaactctgagggatctagcgtggggcattccctcccatcttggggagaagaagtgagcctggagttggagcaatcaaattaatcaggagaacgatgatgaaggcctctgccaaaaaggttatttcagagtatttcttggagtagtggccatagaccaggacttggaaacccttctgcctggcaggtatttagttgtaactatacttgccacactggaatttggactttatttcagctttacaacattcaggagttttatacggtgcagtagatagagaaaaaagcatgtgatgcattgcatttataaaaggtacaagtcccaacaagggcaaagggagatcagataagtctgtttcgctttcatgtcagggcagtgctggccagacaaagtgccgagggctttgaccggcatttatgaccaggcagggcactgtgactttatctaggaactggtgaggccgatgaaagcagctgcttctcagacccttctttgatattctctgcttttttttttaaagcagtgatttctccctatttattatcttgctattctcttgccaggtagaatagggtctgattaactttatttagaatccgacacacacacacacacacacacacacacacacacacacacacacacacacacacacaaaatacctgatacaatacgtgaaatcccaccactcaatgactattagggattaaaacccattattgtttctattacggagtgaagagtccagagaaaagagggtatatatagagtaaattttgactgggaagatttcttaattattttgaattgtgaagtacacataacaaaaatgtaccattttaatcattttttaagtgtacagttcaaggacgttaaaaacattgacactgttgtgcaaccatcactgcccccatctcagaattcttttcatcttgtaatactgatgacattcccattaaatgataacttttcatttccccaacacctggcatctaccattttactttctgtctctatgaatgtaaccactctaggtacctcgtataagtggaagcatacagtatttgtctttctataatgggcttattccacttagcataatgttctcaagattcctccatgttgtagcatgtgtcagaatttccttactttaaagactgaatgtttaattttatgtatagactgtattttgcttatctatttgttgaggggcacctgtgtggctgccacatttcagccactgtgagtgatgctgctatgaacatggatgtacaaatatatcttcaaaaccctgctttcaagtatttgaggtatatgcccaagggtgtaattgctgaatcatatggtagttctatttttaactttttgaggaattactatactgttttccatagcagctctaccattttatattcccaccagttgtacacaagggttcaaatctctccacatctttgccaaagcttattttatgtgtttattttgataatagctgtcctaatggatatgaagtgtatctcattttgggtttcatttgcgtttagggagtttgtttgttcttaattctgcaaatgtataggccctgtgtcagatggtggggatataaagagaagtaagtcccagatagaaagcacaagatctcggccaggatcagggggatgctgctgtggaggggcctgggggaaggtctgtgtaaagtccctcgatatggagccatcacttggtggaaagagaagcaaacctccctatttccataatcttgcccaaggccagcctcttagagctcaggatgctgagggaggctcctgggaatgagcaggagaggagtggagtcaaaggtctttgaaaagccaccatgcttctcattgtaagggtccctgcaggcaggtgagggggtcagaccaagtgctttctgtggattgagagtagtagagacacttctgatttttagggaggaattacaccatctggagaataagagcaagaatacctgtgaatcttccttgatctaactccactagccatgagacatgtgtcatcctgatattcctgcattcccaacacctcagtccccaaaatgcctgatctcgagaatgtgccatgctgcctcaagaccagcctagctttcacagcaggggcctccagagtctggcaaggttgagagcagaatttagaagcagggttctgtttcatgcctttgatcctgtcgaaaatagtgaaagcatttgccagagccagctggcttctcagggtgggggatggcacagccgccagcctcagcagcctcttgtgcccatggcaactacaggtccttggaaaaccaaaaagtgcactgggcttttgcaggaacatcagctacccctgaatgaaagctccagcatggaatgcttgagaaagaaaaaatgtatggagggagagaaaacatagaaagggtattttctaaatgctacaagttcatttctagaaatatcaggctataacatcctttacaaattaacaatttgaaggctgggtgcggtggctcacacctgtattctcagcactttgggaggctgaggtgggtgacctgaggtgaggagtttgaggccagcctggccaaaatggtgaaaccctatctctactaaaattacaaaaatcagccaggtgtggtggcgggcgcctgtaatcccagctacttgggaggctgaggccaggagaatcgcttgaaccgggaggcagaggttgcagggagctgagatggcaccactgaactccagcctgggtaacagagcgagactatgtctcaaaaagtaataataaaaatgacaatttgagccataataggacatttcattcccatttttgttgcagatggcctgatacttggtatatttagtaccagttgttagaattattctaacttgtaaattatatagcagctgggatgatgtatgtggatcactttgtgggctgcaaagctctatggtacccgcaagatgtgtgatgtaaggacatgggtgtctttcagtttttaatctgtgtgagcagatatttccagtgaataaaaatgtgattctgaaaggattactgttattcaagagcaattataaatgcaaacagagtttttgttcttgcttctgctcctcatcctcagaatatgtcagtggtgagacagatagattagatagattagatagattagatagatagatagatagatagatagatagatagatagatagataagatagatagatagatagatagatagatagatagatagatagatagatagatagatatcacagcaggcagagagaaaaaggagtggtgacctaaatatttcctcatgcttaagaaacatgtattagcagcagtaaagaaaattttggttttaaaaaaatacccttaattattcctttctaatagaagaatagctttttggtttggttttttcttcttgacatccttgattgcaaagaacagaaacccactcaaaccagcttaaacttttttttttttttttgagacagggtcccactctgtcacccaggttggagtgctgtggtgcaatctcagatcactgcaatctgtgcctcctgtgctcaagagatcctctcacatcagcttcccaagcagctgagaccacaggtgcctgccaccatgcccggctaattttttttctgtatttttagtagatatggggtttcaccatgttgcccaggctggaaaccagcttaaattttaaagtaataataacagatgagtttattggaaagatacggagatattttatagaatccaagagcaggaaagaacacctgccaaggaactgagtttagcaatgaactagaaaacgcacaggaaccaagcaagcagttcctctcccctcctctcccactcttaggcagctagtttcagcatccactgctcttctgggtcttatctctgcctttgacccctctctctgcacaagcagcctttctctacttcatctgcacatggcccagcctcggctgccccaaaatgccacccacaggcccaaagtccacatctcatccctgtaggcaccaactgattcagcctctcagattccagtttaccaagagagaactttgattacccagcccagtgtgagcctggcccctccaggatcaacatctgcccgcagagtataaacatgaccgcgggggcagttctcggggaaggggcatgtgctagataggggaccctacaagctgtctacaatgctacacagcacttacggtacttgtctatgtgtttagattctcgaatatttttgcaatcataaattacttcactgagagatttttctcatttttggttttaagtgaagtatgatctttgaaactatggtgtaaagtgagttgttgggatttatctgaggattacagtcctctgaattatcttagtatctcatggccaaatatcatctaaaattagccatattcaaagaatgtgttcactgaataaccgtccacgtgctttgtcatttgcaatcactcttgagtgtcctaaaaatagaattactttacagatgtatttagttcatcggaaaagtattggttactcattttcttataattctaaatagtcaaagataactaactcccttttttcttttctcacttacatatattcagccataaagtcagaagatgtgcccatttcagggtacacattttcagatatatttgctcaagtcaaggaaaaatcccctaatcactgtgttataattcaccaaattagaaatgattaaagttgtcagtttggaaatgagagaaccttatttttagtcaggtagaagtagatctacaacttcttaagattagccaagctaggctgagcatggtggctcatgccatataatcccagcactttgggaggccgaggtgggcagatcacctgaggtcaggagttcaagaccaccctggccaacatgatgactctctgtctctactaaaaaatagaattagccaagtgtggtggtgggtgcctgtaatcccagctactcagaaggctgaggcaagagaatcgcttgaacttgagaggcagaggttgcagtgagccaagattacaccactgcccactgcactccagcatgggtgacagagcgagactccatctcaaaaaaaaaaaaaaaaaaaaaagattagccaagctagatttcagatcaaggtggtgcctatttaaatgctaaagaacacgatctaaaccaaaaagttcttattttggtattatttttctaagaaagatatttcaaaactactagatatacatagttatgggaaaaaacaaaaggagaaatattatgtatatgtatactgaattatttataggtgaaatattatgacgtctgaaatttgcttcaaaataatctagggtggaggttcatgaaacagggttggccatgtgttaatagctgttgaggctggacagtgggcatacaggggttctttatactcttcttctatacatgtttgaaactttccataatatttaaaaaatggcaaaaatactggaacataaataccttgagtcatttacattttaagccttacaagattgttgccattgtaggaggagaattaggaaatctaacctttttcaacgtcaaatccaagattataattgtacatcagactgaaagactatttttgcccaacattttccttggggaaagtcctggatttcttttcaaatgttcaagtaagaccagagggtggggaaggaatgagcatttatagtttgtgtgttctgtttctaaactttaaaggcaaatttagaactcagtcctaagtaaatgtgaatgctcacagtaagtgttttatttctaattgccataatcttccaatgacataattcttgccaacacagtttgctgagaggcaactgggaaaaacagggggaaaactgatttttctcaggctttggaaaactatattttcagtgcagcatatcaataaaacatatcaagctttattcttctgttatttgaaggatgttgaagatcaaatattatgaagtccatattctaaaaatcacagctttggggtttgtaccacatcatgtaattggctgtacatgcccttctgaataattcaaaatgtatttactcaatttgtgagactttgattaaaatgaatcaaaatagcacccatgcttctcattttataataaagagataaagtcagattttaattatctctctacttcgttctgtcgtaacaggaaaattattgcaagtgaattcaggtgccagagaacaacttttttttgaagctccaagaggcaaacggcatataataagaccttcagaggtaataatcatacacaaagatttttaaagatattttgtgaagatttaatatgtgcattttaataaaacctatcacgttaaccactaatatgggttatatttactatacctttaagtttgatcgtgtcttcaatctgattgcttaatctggtttccaggttcccagaacatatggatttatcacaccactggtgtagcaatgtacagttggtgctctgcttaatttttctctgcctgaagacaatgaataagctagcaatttggatgttatatattcctttttccatttgacatgtcattttgtgcaaagctttttatgaacatatattttgaaacatgttttctcaatggttatttgtaattatgaacattattatctataacaacagaatttttttttttttttgaggtggagtcttgctcttttgcccaggctggagtgcaggggcaccatcttggctcactgcaacctccccctcccaggttaatgtgattctcccaccacagcctccctaatagctgggatcataggcatctgccaccacacccagctaatttttttattttatttttttagtagagatggggtttccccatgttggccaggctggtctcgaactcctaacctcaggtgatccgcccacgtcagcctcccaaagtgctgggattacagacgtgagccaccgtgtccagcctggaaattattttttgagacaaaaacaatctgcaatctgaccattgtattgtatcaaactgttttcttttttccatgtttcctcatgtccttagctacatacacgattttttagttgctgaaatcaaagcctagataaaatttttgaatccctaaactaacacctcttgaaagctagatggcttttgtagatgcgtacctctttcagggtgtacacataatgagccctggtctaactgttgatgaggatgaggaaatattgcttccttagaggaaaaggaggtaagggtatgccactgagtggcaggcatctgcctctccctcgcttcagtttgccagtatcttaaactgtcccagtattgtaaggttctccctaagacatttggacacgtgtacatttgcattgtcattgtttgtaaaggaagtatatgtgtagtacttaaaaaatatacatcgttatagatcatggcattgtattaatggaaactgttcactgagaaatttgatctcactcccctccccaattccaatttatttgtctctgatccgtcctctttttaacttttttatatggagaaacttatggccttgagtaagaggtatttttaattacgtccttcattcactggtaatttgttgactgccagatactttatacacctttatttttaattttaatttcagctttgattttagattcggggatacatgcataggtttgtttcatgggtctgttgtatgacactgaggactggcatacaaattattgcatcacccaggtagagagcacagtacctagtagatagtgtttcagcctttgccacctcctctctctgccccccaggaatccccagtatctgttgttcccaccttcctgtctgtgtgtacccaatgctttattcccactcgtgagaacatgtggtatttggtattctgttcctgcgttaattctcttaatataatggcttctagctacatccatgttgctgcaaagaacattatttcattattttttatggctgcatagtattctatggtatatatgtaccacatttcctttatccagttggtcactgatgggcatcttggttgattccatagctttgctattgtgaatagtgctgcaatgaatatatgagtacatgtgtctttttggtagaacaattccttttctttggggtatgtacccagtaatggtattgctgagtagaatggtaattcttttttaagttctttgagaaatctccaaactgctttccacagaggctaaactaatttacattcccaccaacagtgaataagcattccctttactcttcagccttgccagattctgttttttttttttttttttttacttttaataatagccattctgaagggtgtgagacagcatcttgtggttttgattagcatttctccaatgattggtgataaacattttttcatatttgttggctgcttgtatgtcttcttttgagacgtgtcttttcatatcttttgcccactttttttttttttaagacccttttctaagggtcttgctgtatcacccaggctggagtgtagcggtaccatcacggctcactgtaaccttgacttgccgggcttaggtgatcttcctgcctcagtctcccgagtagctgggactgtagatgcacaccaccatgcccagctaattcttgtataatagttttagtagagccagggttttgccatgttgctcaggctggtctccaactcctgttgccctctttttaatggggttgttttttgcctgttgacttaagttccttttagattctggatattagacccttttcaggtgcatagtttgcaaatactttctcccattctgtaggttgtctgttttctctgtcgatattttcttttgctatgtggaagccctttagttaattaaactcatcaagtctcacttgtcaatttttgtttttgttacaattgcttttgaggacttagtcataaattctttcccaaggccaatgtccagaatggtatttcctaggttttcttctaggattcttatagtttgaggtcttacatttaaatctctaatccatcttgagttaatttttgtgtatggtgaaatgtaggggtccagtttcgttcttctgcatacggctagccagttatcccagcaccatatatttaacagagagtcctttccccattgcttatttttgttgactgtgtcgaagatcagctggctacaggtgtgcagctttatttctgggttctctattccattggcctatatgtctttttataccagtaccagtctgttttggttgctgtagccttgtagtatactttgaagtccagtaatacgatacctctggctttgttctttttgcctagaaatgctttgactattcagcctcttttttggctccatatgaatttcagaatatatacacctatattttaatcctcataacagctttacatgatagttgtcaatctggttttacagataaggaaactaaggctctgtaagggcaaaagacctacagcactgtgatcttaacccaaaggcatctatgtgtgactccatggcctacaccatgaagcctctcaatttctcctgtggatttaagtgtcatttcacatcacttcagctgtactttcccttccggttttagtgcccccaaataagtatactaaaatgaaatgtaatttaaccaaatggtagaggaggatgaggctggcttggaacagatgagcaattattatataaaagataatgcacaaaaggaaaattcatgttataatgcttcccaaagtgacaggctcttgctctgaagagttaagagttaatttgttaccctgtggtgcacatttgttactccagaggctgattcctgatgatgttggttgcagagtccttccaactgatgctttcttggccaacttccctagtagtgccgctactgagagcattgaagaggtagctcatcatgttagtcccaatattataaggccctttgactgagcatgagggattttggaaaatctttttcaaagaagcaatttttttttttaagaaacaatcatggtaaactaataaaaagcttacccagcaaattgttaaaatatgacaaatgttaaaatgcccatttcaaatccatctgatacaaatggtacagttaaagcagcaccatattgggaggcaaactctctggagcaaacctcccccttcggcttcctaagcatgctgtgactgcagtgatgtaacctgtctgtgggcctcagttgcttcctttgcaaaatgataacatgtctacctgaggcaaggtgctaaggaagggatcccttgaggactctccttccatcttagttccagcattttcaacaagtttatttaacccttttgcattgacggattataggtatcatttttaatgctccattttaagtgcaatttctgtagcttccagcaagttcgacatttgcttcccctggagaacacggtgccctgatctggccaacagtgttgtgttggggtgtctgccaggggagcaataccagctccctttcctttcctgctgggatgaggccagcatcactgtagggattgcgagtggactaggagagtcttagagatggaatctagaatttggaagggagtcaatggccaaaagcatgcttccagaaccagcaagggatggttccctgcttctcttcctgtgaaggttaggttaggacatcataaggggttgagggactccaattctaaaactgaggtgatttctgggggaaccaccttgagtcaccttggtctgtgttcctacccaaggcccccaagtcacaggaccagattcagatttttgtttccacctctgtgtgcctccaaaagaaacacacaagattaaatgagaaatttgagggactaacaaatgtatagcaccttaccacgttgtgactaaaactcctggctgcatctttatcttgtaatttctcttctaagcaataacaacaagcagaaattaggcagggtacattagcagcgtgcaaaacagtttcaaattcaaaaagagagatctgggctttaattttagctacagttctctaatttcttttactccagtgctttctctaaagaaactggaatattaaggtataatagcagatgttgaatgaaagtaaatgagataaaatctcccagaaagccataatgttgttgttattgtctattattgttttaagaaagtggaaagaaaaacctcagtcttatcaggatttaacctatacaaattacaaatattctagccaagaatttcagacaaaacagttttaaaggataaaagattcatggcaatagaatatgaatagctcttcagatttttaaagtagtctctctagagcatacaggatattaagcttgctgcagaatcttattactttttcctccaaggaagcagtcatgttttttaaagttgtgtcttgtaactttttaaaataattggctaaatgatcatctccattgatcagcctaggtcagtgattctcaactgagagcaattttgtttcccaggaacatttggcaatgcctggggacaagggtatgctactggcatccagtgggcggagaccagagatgctctaaacatcctgacacgcacaggacagtcccaacaacaaagaattttccagcctaagacatcagtgctggcgttggggaatctggatccagcttatggcttatacaatgataaatgtctagttaagaactaaaataccttattattatcaaatttccacaatttcaaaatgttcattttatctagagaaaaacatttgggtatttgactgcagtgttggcttctgaagacaatgcaaataaccactttaaatatgcaacttagaatttgtgtacctcagcactcaacacaaatgcctaacgttggcaaagtaatttagaattactcaggtgcaaactgtttcttttaaataaaacaaactaggttgtgcaaaaatatcattctctttcgttctttttcagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaaggtaatattgcgtgtttattatctttacttgctcagtctccttaataaccttaaatattgtatctaagtgcatttttaaaaatttgaagtcataagcaattcacattatcggagtattatttatgctgtataaaaacctccctgacattgtgtttgagtgactaatttcagtgcaattctcatggcatagaattctaccttgaaaggccttcagtggtcaccaaatccaacatctcacaaactgcaaagtaagtgttacctttacaacctcacagaccagtgcctttctaactttcattaggatacttccacagatgaggaacttaatatcacacagcaccccaactgatttttaaatacctccaattgttaaaacgtttttatctatcttgagctgaattctcttcttccctttttttttttgtttttttttttttttttgttttttgagacggagtttcactcttttgcccaggctggagtgcagtggcgccatctcggctgaccgcaacttctgcctcccaggttcaggcaattccctgcctcagcctcccgagtagctggattacagacgcctgccagcacgccagactaatttttgtatttttagtagagagagggtttcaccatcttgaccaggctggtcttgaactcctgactttgtgatccacccgccttggcctcccaaactgctgggattatgggcgtgagccactgcgcctggcctcttttctttttaaataaagttctaccttctgaaccatcattaaaccattccattcctctaacagccgtcatctgtagtaagatcacatttgactccccgaagtctcatttttttttccagcctaacctttctagttgcttcagccatttcccatattcgatggcttacagctgtcccctcccttaagcacagtccagtttatcaattcttccttcaactgtctagtctagaactgtattcagtgttccagttgtaatctgatcaggtcagagcacagtgggactgctaccttcttggttttgagttttacacttgtgttaaatcaaactaaaatggcattggcccttttggctgccacactacaaaattgaatcatagacgtcaatctcaaaaatgttcagattatccccaagcctgtacttacacaattgattttctaagatctgagtacagaactttacatttatacccaaagagttttatttatttcttctcagtgttccatcctatctgtatctttgaataccttgtcagagcattttctctcccttgcagcatcatgtcatcctctgctttcacaatcccgagttctaaatcatagaaaaaaagacagactggaacaatcacacgtcaactcaaggaacctccccctcaattcagttttacattccatttatttatttattttaactaatgaatgaatgaatgacagggttttgctgtgtttcccaggctggaatacagtggcacgatcaccgctcactgcagcctctaccttctagactcaagcaatcaatccacctcagcctccccagtagctgggattatgtgcataccaccatgcccagctaatttttttactttttgtagagatggggtctcactatattacccaggctggtcccaaactcttggactcaaacaatcctcccacctgggcctcccaaagtattggaattataatcatgagccaccatacccagctgtcattctgtttattaatctacacgttgtaacaattctttaatcagtaacagacatttaaatttacccccctgtacagtcatttatcctggtccaagaagacatcattaaattcttggcaaatgtcttgcctaaagacaagtggatagtggtctctgtcatccttaatctctccttctaataaaccaaccaataaaatatgtgaggttagttcacagtgtacccattactgtctggttatcactacttctttttccaaatgcttatcgaactcctgtgtaatatttcatcctagaattttccagggattacattacctcatgaatcaatattttccggagcctatttgttttcccactgggatacaagaaccgctttgtgtttgatgccacctctcctgattcctaaacttttcagctattactgtattatttctgtggtcacgtttgaaggcacctatactcacgtaaatgagttctgttttctcctttgcggtttgaagaacattctctttgacagaggaaatgagaaattgactttcagttcatgtgaagccacctgattgagaagtgttcctaactttcctctattttgcttccccccccccccaatccttttcaaaagtcttattttttgtctttagcattccagaaactacacttaaaagttggtgcaaggcttttgtattcaatctcaattatttgctactcctgtcatttgtacattttaacctgaacatagcagttacctctatggccactttggttactttggacacttttcctttcttctccttcctttgttaataactgattaggttatcatggtgagtagccctgagatacacatctgtttctgtccagtgttacgttcattgcccatcccaaagccgcctggcaaccttctgccaatgatctgtcacttaccagcccttcctatttgatcagaatttagttctaagtagccattttccttgctatttctgtgtgtaaatgaaattgctagcagtacaaggcaaaaagttagtgataccctggttttagtagaccaaggttttggagcagctatttagataactaaatcccccacagtactattgcatcttgctagtacttcccctacctgacaaggtggcttatctatatattagtcatttcaagttgtgttcctcagaccagagttccagggaggtatatctcaggtgggaaggaaggaaccagtgcaaaagctctggaatcccgttcctgtttcaacaaagttacactatgttttgtattttgcacattcatcttctgtgtatgcttttttctaagattttattgtgaagattttgaagcatacacataagacgagagaataatatagtgaactaatagaaacccacaacctaaattctgtaatttaaagtaaactgtagaattaagaaagaaaaataaagatctcaaataacctaactttacacttcagaaaactaggaaaagaagaccaaactaagcttcctgttagcagaaggaaggaaataataaagattagaacagaaataaataaaatagagactataaagagaatagaaaagaccaatgaaactaagagttggtgtttttgaaaaggtaaaattgaccaacctttagctagactagccaaaaaaaggactcaaataaaattataaatgaaagatgagacattataactgatactgtagaaatacaaaggatcataagagactactttgagcaattacatgccaacaaattggataacctggaagaaatgaaacatatctggaaatacacagcctaccaaaactgaagtgcaaagaaatagaaaatctgaacagatcaataatgcacaagagattgaatctgtaatcaagaacctcccagaaaaggccaagaccatgtggcttcatgtgtgatttctcccaagtatttaaagaaaaaatattgccaatcctttttaaactctttcaaaaaaagaaaaaaaattgaaggggagggaacacttttaaactcttcttagaaggccagtagaaccttgataccaaaaccagataaggacattacaagaaaactacaggccaatatgcctgatgaatataggtgcaaaaatctgaaacaaaatactacaaaccaaattcaacagcacattaaaaagatcatacaccatgatcaagtggaatgtgttcctgggatgcaaggatggttcgacatatgcaagtcagtaaatgtgatgtaccacataaagagaataaaggataaaaatcatttgattatctcagtggatgtgagaaaaggatggacaaaattcaacatcctctcatgattaaaaacacttcaattagatatagaaggaaggaacttcaataaaggccataaatgaaaaacccacaactaacatgctcaatgatgaaaagccgaaaacttttcctttaagataaggaacaagacaaggaagtcctagccagagcaattaagcaagcaaaagagagaaaaggcatccagatcagaaagaaagatgtaaaattatctctatttatgtacaacatgatcttatatatagaaaaccctaaagacccccccaaaagctattagaattaataaagtcagtaaagttgtaggatacaaagctaacatatacaattcaattacatttttatatacttagactatctacaaaaactgtatcatcaagacaaataaaatgtttaggaataagtttagccaaggaggcgaaagaactgtatactgaaatctgtaagacactcatgaaataaatcgaagaagacacaaataaatggaaagagatcctgtgttcatggagtggaagaactaatattgttaaaatgttcacactacccaaaaaataatctgcagattcaatgtaatccttatcaaaattccaaaggcatttttttcacaaaaattggaaaaacaaccttaaaatgtgtatgtaaccacaaaaaacctgaatagccaaagcaatcccaagaaagaataaagctggaagtgtcacactttgaaatatacatttcaaactatattacaaagctatagtaatcaaaatgtatggtactgacataaaaacacatagaccaatgaaacagaataaagatgccagaaatatatccatatatattatatagtccatctttgacaaggataccaaaaatatacggtaaggagaagacagtctcttcaatgagtggtgtcagggaaactggatatctacattcaaaagaatgaatttggactttatctcacaccatttaaaaaaattaacccaaagtggattaaagacttaaatgtaagacatgaaatcatacaactcctagaagaaaatataaagagctccttgacattggtcttggcagtgatttcttggatgtaacagccaaagcacaagcaaaaacaaaagcaagtgagacaacatcaaactaaaaagctttgcatggcaaatgaaacaatcaacaaaatgaaaaggcagcctatcaaatgggaaaaataattgcaaaccatgtttctgataaagggttaatatacaaaatatataatgaattttacaactcaatagcaataactatgattttaaaacaggcaaatgacttgaatagacatttctccaaagaagacatagaaatggccaacaggtatgtgaaaagatgttcaacatcactttttagggaaatgtaagtcaaaatcacagatatcacctcacacctgttaggatgtctattaaaaaaagaacaagtgttggtgagggtgtaaaggaagggaacccttgtacactgttatgcccaccaacagtgtacaaattggtgcagtcattatggaaaacgatatggaggttcctcaaaaaattaaaaactaatatatgattcagtaatcccacttctgggtatatatccaaaggaagtgaaatcagtatcttgaagagatatctacaccaccatgttcattacagcattatttacaatagccaagatatggaaacaactgaagtatctatcaacaaatgaatggataaggaaattattgtgtatatatacatatacatggtggcgtattattcacataaaaaagaaggaaatcctgtcatttgcaataatgtggatgaaccagaaggacatggtaagtgagatgagccaggcacagaaagacaaatactttgtgatctcacatatacgtggaagctaaaaaagttgaactcacagaagtagagagtagaagggtggtggccaaggactggagagtgggtggaaatggggagatgttggtcaaagggtataaactttttttttttttttttttttttttgagagggagttttgttcttgttgcccaggctggagtgcaatggcacaatctgggctcaccgcaacctctgcctcccgggttcaaccgattctcctgcctcagccccctgagtagctgagattacaggcatgtggcactatgcctggctaattttgtaattttggtagagatggggtttctccatgttgatcaggctggtctcgaactcccaacctcagctgatccatccacctcagcctcccaaagtgctgggattacaggtgtgagccaccacgcctggccaaagagtataaacttttaagataaataagttctggggatctgatgtagagcatggtgactgtatttaattatactgtattactttaaatttgctaacagagtagatcctaagtgtcctcaccaaacgcacacacacacacacacacacacacacacacacacacaatggtaactatgtcatgattaatgcattaattaccttgattgtagtaattatttcacaatgtatgcatatatcagattctgttgtacaccttgaatatataaaatttttgttaattatacctcagtaaagctgggaggaaaaagtaaattttagacatcaagatacttacccctaaatgtttcatcatgcatattactatctagagttcaagatttgcttatggtattttttaagtaaaatttatattcagttgaaatacataaatgttcagtgttccatttgataagctttgacaaaaagctcatgtacctatataaacatctcttatgaagatacatacgccattgccaccccaggctgcttcctcatactccttctgggccagtccccatgccccctccctccctcagctgaaacaactgttccaatgtttttcaccataaattttacctgtttaagaatttcatataaatgaaataggtactgctttttatccagcttctttcactcagagatgtttctgagatttatccatgttgttgcataataatagttcattcattttcatagctgagtagaattccattgtgtggatataacaggttgttcatccatattcctatgatgaacatacttttccagtttttggttatagtaaagctgctatgaacatttttagacaagtctttgtagacatatgctttctttctcttaggtaaatatataggagtggaatttctgagtcatggggaaaaatatatataacattttaagaaactgccagacctttttccaaagttgtatcattttatattcccaccaaaaatgtaagagttccagttgctgatattcgatcttgtcagatgcataaaattcagctgtccaggggagtagatggtgccatccagttgtgttttcagtttacatttctctgatgactaaggatgctgagcactttgtcatctatttactatttggggaagtatctgtacaaatcttctgtccattgttttaaattatcttttcattcttgagttctgtgtatttcttgagttctctatttcttcaatcagattgaagaaataggttcatggcttaaactactagccaaatatgaattattttgataaaatcacttatttttttttaaaaaaattatttattatttttcaagatggagtttttgctcttgttgcccaggctgcagtgcaatggcgtgatctcggctcactgcaacctctgtctcctgggttcaagtgattctcctgcttcagcctcctgaatagctgggatcacaggtgcctgctgccatacctggctaattttttgtatttttagtagagatggggtttcgccgtgttggccagactggtctcgaactcctgacctcaggtgatccacctgccttggcctcccaaagtgctgggattacaggcgtgagccactgcacccagcctcttctttttttttcaacctgatttttctggcacactttccttcccaaatacatgaatctcttgccaatgaatatttccagctgtatagtcacacttgtctaactgctatcactctgttgaacaaagttcattatctgttatgaacttgaatggttgtgtcttcccaaatctgtgttaaagccctaactcccaatgggactgtatttggagataggtcatttagggaagtaactaagattaaatgagtttataagggaggggccctaatctgatagaatcagtgtccttatagaagagatgccagagagctagctttcactctccacacacacaccgcccgctcttcctgtgagcacacagtgagaaggcagctatctacaagccaggaagagagcccgcaccaggaaccaaattggccagcaccttcatcttgcccagcctctaaaactgtgagaaataaatttctgctgtttagctacccagcctagggcattttgttatggcaacccaagcagactaatgtcccatgccattgctatattctcgcattgagttctatgtcatcagtcttggtgatacctgtgagatcttattaccaccacagagctctgtgtccaaaattcaagttccgtttgttggctgctaaaatcacgtcactatcttggctctttttctcattctactttcctatgagtgggcatctcttccgggcatttttctttccatgccagacaagtatctttattaatattcagttttataggttaaagccttcccaattagatcattagtgccctgacagccaccttgtcccaacctccatgagacataccctatcctttatcagagacttaacaggagcacgacccatttttgtagtaccttaaaccatggaccagaaaaccaaattctgttttttgacaccatctgtatggcctgcagattgcttcccatagcctcccttcccttccgaacctagacccttttgctaaatggagaggctaaaataccactgtgtcatttgcatttttaaaaccctccatgccctcaagtccttaagtttcctcctcagaatgtgaaaagctctggaggatgattcttcagagagaaactttgcatggaaaattttatagacagggaaactgaaatgtgaatgtaggggagagtgcacagctttcacgagattctcaggaatttcttccctacaagggattgacaaccactactctggagacatattccagattttttttgttttaagatggagtctcactgttgccaaggctgtagtgcagtggtgtgatcttggctgacagcaacctctgcctcccaggttcaagcaattctcctgcctcagcctcccaagtagcttggattacaggcatccaccaccatgcccagctaatttttgtatttttagtagagtcagggtttcaccatgttggccaggctggtcttgaactcctgacctcaagtgatctgcccgccttggcctcccaaagtgctgggattacaggcatgaaccagtgcacctggccatattccaggtttttctggtgctatcatccattatttcatcacttgatggatagagttgtggtgaagcagcaagttctgatgggtgtaacaagtgcagtttggcttgaagacccagaaaggtcattcatcccaatggctgtgccaggtcttgaggacgtttcctccgtaggccctgccgggaaccactatacatccctgccagtgtctttctcttgagacagcagctggtttcgcagaaccttctagcaactgtcaattccctttattgttgcatggagcagtgattttctttcctattctgagaatcttgaatcacccactgctgcaggaatctctgccttgttatatctcttcagtggccctgaattttttcctctctctttcttcctctatgtcccttttttcccctctgcaacctgaatctcatcccttagagtctgtttccttgaacctttctttttgcattttttcttgccatctagaaaccctgtgtccctcttataagttgagggtgtagagaggcatttctcatgctcttttacttctgtaaagaaacagcttgcatttgtagtgtataaactggatgtgctcctgcttccagctagaagaccagcaggacacatggctgcagctgctgtgactgtcctctgtttccatgctttctggaactcacatgttcaaatgggtttttcttggaaattcttttgttctgcctatttgctagcaaactaatgactctggagggcctcctggaaatcctacctgcctgtttgcttcaggaatctttctaggctcagtactctgctgaggagtgggcagttccgctctgccatcagctagtagttggccaaatacagggcgatcttgactaggagtattacaaagtcacgaaccctcctgcacctgtttcctgctgtatgtctgtgctgttttcagattctctagcatgccagtccaaaaccctctgggagccacttgtaaattacttaataaaattttcatctgggatactggtgactctgtcacaacctcagagagtgcatgtggccttccatattctgtaaggtattccctcggagtcgctgagaggatggaaaaactccatgtctttaaatggctcccgctgcagctgtttttgccaggctgtggctcatgagctgaatatggaagctttttctggtgccagctttgattttgcaccacttgtcaggactgccctggcatgagcagctgactcacattccaccctccacccggggataaaggtggggtggcctgggcacaccactccaaaaagcttttagtcgttactgataaattgggttgtatgtatttggctatgtttgttgaaaaggagctttgctttaaatcaatgtttgcgtgtttgtattaaaaattctttctagcgtctgtggcagaaaccgttgtgttcattttacatcttacttgaggtcccaggtttataagatatcctttgctcttctgccactgcctggactgtagtacaaaagtcactgtaggagatggctgtgaagacacttttgatctcagatgtcagccagactcacagtcaggagtttacactagagacctgtggaggcagcacatttgacatttgagagaaccagaacaagctttttatatgtctatagattcccagaaaataggttctgtagtctaacatttcattcattccctcaaaaatatattgaggacctattgtgagctgggtactgtttgaagaaaaaagagacctagtgcctgcccacatggagcttacattctagttgaaatgtaggaaattgctgttgaactgtttcctttgtatccagtagaaactaacatggataaacgagcccagagaaaggaataacagtggctggggtaataaccaatttcgggctttacagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggtgagccccccacctgccacatgcctcctgcgccgaatgcacctcccaacacctcccttcctgggccactgcaaaccaactggctccccaatctctttctgttgtttgaggctatgacagcgatgttgctagagaaaaggccattgactacaccaccaagatttatgctgtgagcatcagggaaatggaaggcaccaagccacaccagcagctgaaggaagtttccgtggaagaaaggtatggtgttgccaggtttgcttgcttttattatacctgatgacaagaaacttgtttaagccagagtgcgttttctttgccctcaaagttgctgtttaagtcagtcttttataaatcttcacagagtcttcacctgtacacaggcttaagctgagaaaaaattgcacaacatcccagtacgtggcaaagggcggtttatactttgtggaagttggttatggaatgtgacttgaatagacatgaaatttagttggactacacttctccatgcccagaaaaaaatgctagggtagccccaaagcagtcctgactgtggcagctgacaggaaagcctgctgaccagcaaggtaggagggaggacaggattctgaggtcatggaggaatggctgcagagttgtgaaaaaccatcttccattctaaccagaatctgtgccttatactccattcacttggtgtatcttctcttactgtgtcttcatttgcccagatttgtccaggtgggtttggcatttccagcctatcccatttggttttattgccttggatcctctatatagaatgagtgttttctagtattattttggggcttttcaatgtgctgttataagtattgacaagaattgtcaaacactttagcatttctaaaaagaaaagctcagaattactatattacttaatttatcatattcatgctaagagtggatattgaataaaaactcttaataactaaagagaatttcgtggatctcaaagatgttttaataattctgttggctgttcacattgaggtaggctcgatgttgacaatacgctggtcccacaatatgtaatttatgagattcaagtagtttgcatttagtatggctttctgcctaacaacaataagtctgacctatcacttcttactattatgtggggttttagatgcaaagaaatgtaacctcctcctcctcctcctcctcctcctcctcctcctgcttaaattcagtgccagatgttaaaataaacttggtaaatggtgggtgtgctactggcaagaagattgaatctaatgcaaaaaagccctaatttttccctagcatctttgttagatattacaaagatccagagctttcttttaagaaaaaattagagatttttctgcagtggtcttcagagttcattttgcttgcaacatggttttaaagtggccacaaacagaaaataatttttaaaagtcctaattctaagaattaaggggaaaaaagaaccatatgcacagaagtgcatgaataggcctcccacttaaataatccaatctaaaaaaatgtttcacctgaagtattcattcctttggaaaaaaaaaaattacccagcctttctagtttcatttctagtttcacataccattatgaaatgagttgacatggccattatcccaagggtgtttctggctgatttctgtaactcattcgtacatcatgctgagattcatgctagccaccaaaatataatcatttaacccaagctccaaattccaaacactacagctgatttcaaaccctaaccaaggctcacctaatcctcttcttgtctcattgcctctttgggcaaatctgtcaacatttcgtactgccaaacttaatgaaaggtaggaggactgatgatagagaggaccctaagaatttttcattttaaaattcagaattttcatgctaccccattttattatcaagctataccccatcagataggaaactgtatagtcgcatacactggaatgactctttttttttttatcaaaaggaaaaagccttataatattatgaaataggggtaggcagttcagtagtttactggcatttaaaaaaattcacaccaggatttagtgaagaaaacaattttaagataagtatagggtctggaggagtaatcaaaccttttctgtagagagcagcttcctaggtaactttaaaagccttgacagcctcaattcccagaaggagctggaactagagcacacactgccagctgcacagcatgccgggagcagagtggggccctgccaggtagggtcagctagtaaagagcaataaatgatggccaacttagcagtctccatgggggcaaatcacaatcagagccaagaacaagcagactccaccagtcctggtcagtaattttaggggagactgaacctcagagatcagaccgtaggcatcttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccaccatgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgaccgtaggcatcttctggaccacaaaatagaacattgccaggcaaggcagggcatttggggaatttgagagaaagcaggatgagtgatggaattgggagggtggcacaagatgttaaacagcatatcttagtcctcatctagggtataaaacaggacccatggactctagcatcctggaatgacagagggacagagaaggaaaaatggtgacatcaggaccacatgaagccaggcagcagtggccagcttctccctgggaataatcagggccgttgcccagcagctcctgatactgttttctttggcaacttcaagccctgcttgaagatttgagaggcaggggttttccttggtgttcccgtcatcgtgccttccgtatatacctgcagataattctgtatacctgggtgctttttctaaacacttggttcaagacatgcaccaatgagactaatgggagacgagtacttgaggactgaaagagatgtgagcttgggacaaccactccacgcagggtccttagcactgttttgtcacttagcaatgtttcaggcagctctacctctggtaaatcccctgtcacctaaaagcaattagaaaccttgagatgactgtagcacctgtcgtactgagaaaaatgccttgaaggtagctgtgctttatgcatcaattacttttgaagcaactgaattcctaattcctaaattttaagatatttgtggattgtttctaattagactcagttatttgactttaaaatagctgtgagatttcagatcctgcttctttgcacaattgctaattacattgtgagttcttattcttcagaagccatatgatcttcagttctaatctttcagaaaatgaggaagctgagaagaaatttacagttggtctcaaaagaatcctgggctacacctaccagatatgtaatgtccatgaggtgttcagcgggtagcccagttactccagctttcctctaacacactgggataccctgcctccatgacccagactcatctggctggtccccaaccttgggtgatcttgctgctcagctgccacgtgtggtgtgtggctgaggaaagtcatgaagtcttttttacttttgggaatccatgctttcactccttatctgggcactcagggctaccccacgctgccctccttcatccccagccgacttgacgctaattctggtctagaggaacccttccaaaccttcccacctctcaagtgccacgccccaacctgacacacctcttactctcaacttttgaccttatctcctttgccgtgttttcttataatgtactcttttgtccatctacaaacttaagatatttaattgatactttaaatatcagaaaagttccttttgggagaaaaaatgaaggaggaaagcatagtttttcagagcaatttaagatacaaaatgcttatatcatctcaacatgaggtatggtgcccaaatcctgtattcagacttcggtaaaaacagttttccccaattcgtcaagtgatgaaatccctaaggtttgcttggtaccaaattactagagttgcctgttaaattaagaattttcttttcacgttaccaaagtcacacctagcttacatactgttttttgatttataacataggggctttcaagggggtcacccaacccaaactggcctaagcaaaggggaacttactggtttacacacctaagtatgcaggagtggggcaacttcaggtggcacttgttaagagaactcaaatcttgctgccaggattctggttttttccttcatatctcagttcttcttcctctgggttattacagttcttcaggtagaaaaatggctgcagaacttatagtctctgtggttcaaaatcagtaggaaagaactgcctctgattcacaagttccccctacaaatgtcttttgaggtgctattggctctggtgggccccaggactacccttgaaccaatcactatgggctaggaagaaaaagtctttgactcttaccttggaaatagtcacctgccaccatagactagcaatgtaatcacttcacctctctgtaatcacttcccccagaggtgatttggacagacccaaaatagaaaatgtctattacagttcacccttttcttgtcatatatattctcttaaaatggccccatttaaaactattctatatataggccaggcacggtggcttatgcctgtaatcccagaatttgggaagccaaggtgggcagattacatgaggccaggaattcaagaccagcctaggaaacatggtgaaaccctgtctctcctaaaaatacaaaaattagcctggtatggtggcacacgcctgtaatctcagctactcgggaggctgaggcaccaatcgcttgaacccaggaggcagaggttgcagcaagccaagatggcactgctgcactccagcctgggtgacagagtgagactctgcctcaaaaagaaagaaaaaaaaacccactaaaaacccccactatcctatatgtaatttgaaatgcagttatgccaccttcccaaaaagaggcggctcaaagtctcagccagttgccacatccaggatctgagagtactatgaaattttctcatccaggtccagataaagcccctcatggtcctgtggctaatgataatattaaccaccctaacttgccaaatagtggtaaagagaggacagaatgaagataatttttttgaatcaccactttgaaggagggagaatgagacaacacgcagtgatcactggtccatagcgtattgtcttctgctggactgaacaatcaacgattcctgccctagccgtgtgcgagtattatatgactggatggtaatgtgaatgttggaaaataccagcagtcaggatataaaggttttgtttgttctttcaaaacatacacatatggaagtgaaaaataaaagtaggaagtaacataatactctcttaaaagtacagctctccaagtgtcccaggttcctactgggatgtcagtgatgcccctgtattttgtcattctcatgggaaaatttgtatcctcccgccctcccatgagctcctcccttgacgagagactggctcagggcttggctgctccacaggcacgcataagctgtcactttgcttgagggaaggtcaatttttagacatctgccaggagacccacatttcaggtcaatctaaattccgtttttgtcatttagtcctctggcctaagatttggagttatatagtatcaacttagaacatatatacatatatatatatttatatttatatttgagactgggtctggctctgttgcccagagtgtagtatggtggcatgatcctggctcactgcagcctcagcctcctgggctcaagcaattctcccacttcagtcccccaagtacctgggactaggactacaggtgtgcaccaccatacccagcttatctttattttagagatggggtggtcttactgtgtttcccagggtgttctcaaactctttggctcaagcggtcttacaccttggcctcccaagtgctaggattccaggtgtgagccaccatgcccagctcaaaaaatatatttttttacatctcaaactgatacttgaattctcaagggaaagatatatcaattaaacaaattactattttatttcttaagtcaaatcacttgtcactctgccctcatttttggtgataaactgagtatgagttaatttattattggtagatattccttttttaaagtatagtttatattatttgtctctggaaggaatattataaccttttgtaggctcaacaaattttcattaatggtttggtattggcattgcttcgtgtttaggttgtcacgtttggtctttagcagacactcctttggttgggtgtacgtgtcgtttttgtagtaccaccatgtacctttgaaagtgtctgttttttgctaaggagtcccatgcttatctttggtgttcctgtcctgtgaatggcgtctgggctctatgagtacacataagctggagatttggagaacacacaaaatctagttcattctcctttaattgttctttctaatggaaagtggtgattatcacagaaaagaaccttagggtattttactgttgaacagtaattactatcatttgtaactacttttgcgtatgtttttattacctagtattatatctgcataactttttaaaaatcagagatggccagcaaaaattcaaccaaatcaatgtcaagaattattagagacatttaaaactttacccaattaaagtgaaacaattttgatgagtcacagtttttataccaccatctgagcgtgccacaacaatcaacttttaaaatacattcatgctgaggtttgttacttttaaaaattgtagtcttatattcacattatgttttgttattcgcatatatctttaaaaataatgtttaaggccaggcgtagtagctcacacctgtaatctcagcactttggaaggctgaggtgggaggataacttgaatccaggaggttgaggctggcaggagtttagatgagcctgggcaacataaggaggccctatctctacaaacaaaatttaaaaaattagctgggaatgaaaacacactcttataatcccagctactcaggaggctggggtgagaggatcccttgaggccaggagttcaaggctgcagtgagctgtgatcacaccagtgcactccagcctggccaacagagcgagaccctgtccgtgaatgaatgaatcaatgtgtgtttaaacatcttgggctcatctccagaggttttcattatcacattaagagaaagccagaaattagaaacttataactacggaaatatttagtgccaatgtctacattttttgttcttatcaaattatcatgtggcttcagttttgtatactgtggtaactacacgatcacaaaggaacattctttttgataattgatatgtagcatctaataatatctctaagtgtgggttatgatcttttactgaaattcatatgagctgaccaggtattagtcttcctagttacatctggtggagccatggttagtaatttatttttaaatgcctcctgtttgacataggtggatgtcctcatttcttcctcacttaaccggccacataggggttggtcataatggatatttttatttgctatatacagttggaacctgcattctacagaaacccaactttataataagatacagaataaatggagaattaaactattacagaaattggcatataagtactcacttaacctttatgttttgaagaggatacaataattagctcaaggattgttttctcaatgcacctgagtcagccatctgtatttttttcaaggtcctttattaacaactgctgaggcatacagcttttgactgtctatccagggatgaataaatgaatgttagacttaccacttcctgtttctacattatttttataacattattttacttatagcatttttcacctgtcactgaaaagaggtttaactgctccttcttttcttacctgagaagctgcataacttatggccaaaagtcaaaattccaaactcacctaaagcatatttttttccttccgcagtagactttgggcttgttgccagtctctcctgcttagctcaggctaaaacggtcatgtctctctttttttttttttttttttttaaagtctgggccgggcacagtggctcacgcctgtaatcccagcactgtgggaggcggaggagggtggatcaccagaggtcaggagttcgagacgtgcctgaccaacgtggaaaaaccccatctctactaaacatataaaattagctggctgtggtgcacatgcctgtaatcccagctacttgagaggctgaggcaggagaattgcttaaacccgggaggtggaggttgtggtgagccgagatcaagccattgcactccagcctgggcaacaagagcgaaactctgtctcaaaaaaaaaaaagaagaagtcttaggctaagcatggtggggcaagccggttatcccagcactttgggaagccgaggcaggaggatggcttgagagcagcctggacaatatagggagaccttgtctctaccaaaaatttaaaagcctgatgtggtggtttagttgcttgggaggctgagataaaaggatcacttgagcctgggaggtcaaggctgcagtgagccatgatcatgccactgtactccagcctgggccatagagcaagactctgtctttaaaaaaaaaaaaaaaaaaaaaaaaaaaaagtagaaaagttagtttttaatgcttaaattatattgccttagctccaacttagtgtagtttactttataaattatggataactgtagatactgtgatatttatagttttagtcactgatttgttagattttatccagttattcagctgttttacctgggtagatgacatgtacacagccatcttctaaaaaaagtttcaagcaacagtgtttttatatactctatcaatcaaactttgtgcattaattaaatactgtttgtatttaaatcattatggaatctctgacttctacaagagttgggtcaatgagaatcaaagcaaaacttggctccccttggatttcctcttacgtataaaacctctttatacgtaaagaggtttgctttaatcccacttctgacaccaatctgcttcgtcctcacaggacagtgatgttagtgatgtgaatgatggaaaagtgattgtataaaagttaggtggggccaggtgctgtggctcacgcctgtaatcctagcacattgggaggccgaggcgggcagatcacctgaggtcaggagttcgagaccagcctggccaacatggcaaaactttgtctctactaaaaatacaaaaattagctaggcatggtggcgggcacctgtaatcacagctactcgggaggctgagggaggagaattacttgaatcactccagcctgggcaacaagagcaaaactccatctcaaaaaaaagttagatgaagtttctgtaattttagggtatgcagaaagctatagatacagttacataaggcaggagctaatagcaatttttaggcggcactgttagggcttcccaagtccctctcatgcctcagtgagacatacagccatgcttattggcatttttccaagcacaagaggcttcctttatttctctgagatgtattttatacttttctaccatctcctcctgaaacacatacccaaatgtttagcagaatctgagtacatgcctaccagctcccacagtataagtaactactacaaaacagttctaacatactttgacacgtccactatgggaactaactgactttggcttcaacagaaccctgcctcaggcccaggcttcacgctgtctgaggttctcttcagcacaatgtgatgggttccttggacatcttctggctgcacctgttcggatctctgagaagattttgtttgtctttgttctgttttgccaagtctgagattggcactggggaaaattgcctttctgagggctttatttttggtttccgtattatctcatttctgttggtgggagacctgggagttgccttaagaactgaacaatcacaggcccttgctgttgacctgatcagggttacacgtaaagctctcctctcccaagtaggttgtcaactctgtgaaagcaaaatttctgttttatacactgctttatctctataatctagaacatgctggcacttagtaaatgtgtgttgaatgaataaatggattccttaacaacaagatttagattcattttcattctagcccatggattagatatcaaattctgagatcttgttgacactttgtcattaaaatccataatccagctaggaaatctctgcttctaagcagttggcctccctggtcatccttccagcgctcaggctgcagcattctccatctggcttctgcctttaggcaattccaagtagtggtctgaagtggagaagcccttgccccagactgcatctcagtggtgttgagggtagttgtctgctttgtctggcagggaatgtgtgatagtggatgtttaggaggggtctagaggatcaggcaactctcctttctctgtcatacttgctgtaagtttacttccatgtggatggatgagtactgcttccaacagtccccatggacgaggactcatttccaagtaccagtagccccttgtgatatgcacccatatttggctgatcgcagctgtcagcattccatcattttcaatagcccccacttgtggaccagcaggcatgtcataatcctgaagggtgatccttatcctccccgctccctgcagtgcccctgcctgggttctgctctgtctctcttgaccctccctccaggcaacagcagaggctaacaactttcatacaagagatggttgtcctggtttaatgagatttgggcatcccatacaagtctaggggtgtgtcccaagtggaattcctctcccaattctctgtgaagagaggggaaaggaaccatttcacttcacaaactgccttccactatagaggcaacttaactctccagccatctcagcggcccggcacaagcaaacacgaggaggcggtgccagaattattcttagcagcagattataaaggaggaatctgtgaatattctgcattaatattttagtccttgtggaatatattcactgtcaatctatggcatatgttccttaggaaaccaaggaacttttaccaaaccaaaattagaagtagtttctaagccttttataaatggtggtgcccttacctgtgaactgacaggcgctagcaccaaatgacctcaaaattccactgtagtattagcattttccagaatttttattagactgtgcttacagttgaatggataaggcattaaaacctatcttccacctcattctttctgagttgatttgaatgggtttatgaactgaaacaaaaagaaagttctataaagaaaactatatactgtgggcttaaaaaaattttatggggtttcagagattttttttgtttgttttggtcatgttttggtttcaactctaaattaatagccttctttaatccttgattccttaatttattagtctgtggcgtcaatataaaatttcactggattataaactgtgtaggattatcagttccccagtggctggtactgtacctatcatgggaccactgtgtgtctaacgtggtaccttacacttaatacacagcaaacaaatacttttcaaatgaatagatgaatggaccaatttacttagcctgattctcttaatatttaatctgtcttcaagatgctgtgcaagtccattcttggtcagcgaccacttttaccttcacttcattagcaactatggatggtctttgtgggaaatgatgtgactgatgtagaatccagggtgccccagttggccctgggactgcacttggcaaaatgactttttgatctttgtagtatctgtccttcaggaattacaatgtttgtttggtttaaatctgtttaaccccaggcaaaaggaatcaagaagattctgtgtcactgtggctatcatgcctattgtacacaccaaggtgctttgtcagcaggtttacaatgaaacaaagaacatgctcataagtgactacgagaaaacgggaaggatgtagacaggtttccttcagtcaccaaatcaccgtatataagtaatcccagttttccttctaaccttttatgctgtgcttggaaacagaaatctgggagaagttgcccccagtttgtatttagtttctaattttttaattgacatgcaataattttatatgtttataaggtacatagtttcaatattttcaatgtatagtggtcaaattggtatcattagcatatctttcacctcgaacatttgtcatttatttctgttgggaccattcaaaatcctctcttctgctgttcactcatatgtggaagctgcccccagttttttttaaacgccttatttaatcaggagatctgtgggaatttcaagctcgcctgaggcatgatgagcatggtgaagtggcacagtgtcaacggcaaatgagcaacctgtgctcccagctccttcctcagcgtagccggacagaggccctttgttgtcattgatcaatagctgttttgtgggcctgtattgttagagttgctaagaactgaccatcctgctaagctaatgctgctggatttaccatatagagattgatgaaaactgctcaatcctatcttgaagcttggcccaataaatggggaggaacttctagttctacatttccatcccgtttccaaggctggagtgagcttacagagcctgagagttggtacagagatctgcagttgcatgtgtgttgtttaagctgagcccagctctccccatgggagagtgatggcacacgcgtagtgcacgcagggcgaggagcactcctgctccagagcccttctctcgaagctgcgttcttcttcatcccaccccttcgttctgcaagagttctgcccgcatagctgcagcgagcaggtagaaatgcaagactcctgttctttatgaagttggaagggactgaaattataatatctattaaacccagaaatgctgaaattaatcatctccaaggcctattgcttagttaggtaactccactaaaagctgaatcattcgttgatttttttctaagtgaatatgatgctattttcataaatgattttctttattcaaaccccttgattttctgtattggtttgaagcaaagcaatgacttctgtctgataattttaggcattaaacctgctgttcattatagaatagtttcttcacttttgatgacaaagagtggccagtgtataaaaatccagaagtaaagtgttggaaaatgatttttagaagcttaatgtgcctaggaaatcacactcccacagtgtaatcatcaaatcaaacctactcacttatggagataaaagaacacttcaaaaatatgtaagcacttttctgtcaaaagggagtgactctccgaagactgtggcagagttgggtctgattcttttaggcaagtgtctgaacatctcacagattctccatctggggggaatgggcactaccaggggtgttgatctgcctcctgtcaattagtgtgtggtcaggatgtggtaaccgaggaggcatttgcaggagtggaaggtgtgaaggatcagggtgctcttgtgggtgtgtttaaactatgttggcgtgctctttacccgactccctctcgctcatttgaagttcgtgtcatgctctgccatcttctgccccttcctgttcttgtcatctgtcaacttcctgtctctgagcaattcagctcatggtcaactggccaaccccagccagctcctgccatgccctgggttacatcatcaccaggaactcctttgtccctcagtgtcttaaccagctgtcctctggatttctcattcccgggtacacctgatcttcatcaagacaaataagtgcctagacaccttcatttttccccaagttcatcagcccttcctggcctcactttttgtgcctacccaaatgccatttcccagtcctgttggcccttctcccctacattcctcctaccacctgcctctccactcttcttataggaagtcccacgttggcacagatggccaccaccagagaggctgcctggctgctgcacatggccctccaagctcctccatcctttcctttggttggttttctctgctgcttctcagcagtcatccaggtttcaactcaacctcctgcccctccttcactgagaaaacagaagccactggcacgcattccatcttggtgcttctttctctctcctccattttgcttcccatccttcactcacgtaagccattcaccttcttccctctcttctcagaggaagtaagtcccttctcctattcaagacagttccctcacctggtgcttggccccggcctcctgtccatccatgctccctcatctgtgtctcctgtgtcactctcccacagccagatccatgtcctcaaccaaaaaatacatcccagtttcccacctccacccagctctcctcaggaaaaaaaacaggtcctttgattaatcttataaacttacacatttctgccgtcaccttccttccaacctttttcctttctcattcaggccttgtagtcttttcttcattctctatcctatctcatctgtcctctgtccctgccattctgctgacatgggggctctttaacccctgagtccagtgactctcctctctctgtcttactaagagaacttgtttcttctagagtagcattgtccagtagaaatatgtgagccacgtgtataaattttctagcaggcacattaaaaaagttgagatggtgacattgattttaacaatatattttaactcgatatattaaaaaatatttcaacatgtaatataaaattatattttacattctgttaaaaacttttcagtaggacttcaaattccagtgtgtattttatagttatagcacaattcaaacttttgaaagccacatgtggcattggctactgaattggacagtgcgtgttagagaagaatataaacgttcttctctcgcctttttgaaagaatctctcttggcccttctggtgcctccctctctcttctcagtgtctcacctctgcttcctcttccagccccttacatgctgttggtcctcaggattttacctttggctggcatcttttcaccctctaccatctaccctctctcttaattaatcttttatatcccacccattggctagtgattcccagggtcatgtcactgactcccatctctcagtggaacttccaactaacaaagctatctcacgggtgttcaaagctcaacgtgccaaaattgaactcatcatcttccctcattgatattttctctctgtctcattccatgatacaaccatctgtccagatatgcaagctggaaaactggtattgcccttgagttgcttttcctacttcatcccctaaagactctccatgacaaagtgctgtgaagtctatttcgccaacctttctttaaatattcacctgttttcttctccataaccactgctccagtcaagtgcttcatcattcctctcttggatcatcacagtggcctcttcagtattctgcccatctttacttagttccctttacgccaccctttgtactctcattttttcacccaaataactttgtattcacctaaaatagccaagtctaagacgatatccccattttttaaaacaacaacaaaaagacacaaagctgtgtgataggcttcagtcaagagcattttcaagagggtaggcttctttcaggacatcctgcagttcttctgcctgaatcctttccatcaccccatcactaagtatctctgtacatgattctggaagacataggaatacactcaacagagtccagttcttaggaatactgttaacagagtccagttctgaagaatgcacttgacacagtccagtttggtcttgataacagagaggccccctggctttggagatttttcctaaccctggatttatcctagagcagtggttgctaatttctctgtgtttctcgcccctccctttctccctcccctcccccatccattcctccctacccccctccttccctcctccttcactccttccctcctccctctctgcctcccccttctcccattcctccctctctccctcctctcccactcctccctctctcctcccatcccattcctccctccctcatccctccctacccctcctccccctcccctctttccccctcccctctctcccctcccccttctctctcccttctctctctccctcccccttctctctcccctctctctctccctcccccttctctctcccctctctctctgcctcccccttctctctcccctccccctcccctttggatttcccaagacattctaaaaccattggagcattttatgccacattttggaagctgaagaaagctgtttcctccaaggacactttgaacattgtctgatgaacacgactcaaaacaacttcaaacttgaatttcttggctagttggaactgagtttccccacactcacacccacacccacacccctctttatagaaactggttggaacgacttggtttctcacaggctgtccaagcctcactccccagttggctctcatgttgtactcatcttgggttgcaactgactcgtgacctcagtggtttcagaagcttccctgagcactttggccctgaatgctcttacacatttcaggtcattgtgtgctctgctccacctcttgctctgtcagcccagtgccttggggagggggaaaggagggacaagtacccaggcattggcctgccttgcgggtctgtgcagggcaagagcccgtgtcaggataagactccccacatctttagttgagtctaagctttctcttcagcagcccagcgctgggcagtgggatgacagcaggaattggccttcccatgatcctgccctgcccacagaatgtgccaactgtttccacagggggtacagggttgtgactctccccacaggcactgaagagcagggccgacttgttactcaacaccaagccccaggctggagttcacagcctctccctgggcttcctgccttcactctgtcttcttggcaggcttctcctgctctccagagcttcggcctgtgtgccaccctctctcctgattatccagtttgtttgctgtcttgccaggctccctccttaaatttcttgccaatggaagctctttctcctttgttccctgaccctgcccccctgcccattctcctcaaagcctacttgccccaccaggcccctttgtgtctctgctcctcccacctccagtctctcaccccctcaccttcccagatcttggccccactgggtctccctgccaatgccgggttgtgcccacagccttcctcgcactcctgtcctgtgccagctgggaatgaccaactctaatgagctgattggactgaaagtgagtgaatgtcctcatgcctccactccttcccacctcagcaaagcttttcagagtcccatttctgatggaatctgaatctagaaggatttagatccacggaaaactgttaaacctccagtgtttggctacgtgtgaagtctctggcagtccctcccacatctgatgttatgaacactgtttatagatgcctggaaagaagcttttaatacttgtattgtgttttaacttgctttcctttggaggcagggaattgtcaagtaagtattcacaccgctctggagacaaacacaggtgtttggtgaacatccagtactaagtgttcacgcagaatccacaaccgcgaagggtcaatacttaaaatccgctgaatttgccacaatgcaggtttcttccccttgctcctctcatcttcagttttgaagcaatacagctgtaaacatatgcttgcgaaatgagaaagaaacattgagattgctttacctttcggtttttttctgaaaatcaaggtgaaaaaaaaaagcatcggattgcgtctgtgtatatatatacaatctcctgtatatataaatacacggtgtttgtgcttgtacgcatactctatattcactgtataatatattacatattatacaacctgtgtgtcccctgaaatcgagccctgtgtttatcctcaaataatgccttatgagccatgccatagttccagtgtcctcttgctctcctcatagcccctggcttgcttttgtcatacacttaaacgttcttaggtgaaagaagaaacccacggatttcatttgaaagtcccactaaaacagaagaaagagcagatgtcctgggaagcgataattaatgtgaaggaagtgtctaattgtgagaactggcatgcccccagtctcccgattttgctcaatttggtggcgatgatgtcagccgggggtgtcgttttgcagagatgtgctgtctacccattcttcagtggtgattataataccgtttggtccaattatcacttatgattacataacgtgttttgattgaagagtttctgagaaaataaaggtaccctgtcttcccctgcacacaaaaagaacccccgcaagccattcgagcaggcaggctgacctaccaagaaacactgggaattattaggctaaattatgagttgaacttgatttggaaacaaagtatccattgtacataactccccacgacatccaggaagatgtcattgtttttctgacagcaagtttctccccagcacactctaagcagagtccccgggcgcattcgtaaagtcacggagagtgtgcgggaagcattgacaaagcttccttttctctccctattctgtaggcgctttagtgcagagtttgcccagagacgccagggtatgagctttctgaatttgtagactggtgcactctttcatttctgttttagttctttgctggcatgctggggaagcatggtgtgtgccacacaggaatgtctgttcacttggaaaatgcttgtgcatgaatgaggtggttgctaatgcggctctaaactgtactaagtttctcacttggctttgtttgctgctttcaaggggatcaaggtaatccttctctttgcatatcccgggagcaataactaattactttggaacatgcggtgggagctggtacagttctttctcgacccatccatagagaaatctgatttaaggaaaccccacgtcaccaagaactggcgtactcctctaggattccattagggcttacacattataaaatctcttcattaaatttggaggccccagaccccaaaacggaggcgggaaaagcaacctttggtgtggtagcagctgaatgcagacccgagtcctgaggcgagggcggagtgggaggcgggagtgctgtctgtctcctgtccctctgcttcctgcctgcctgtctgagaagtgaggccgacctaggcacttggcctgtggtccttagggccctttccgcagcctggcttgtaagtgccacttcacgccacaccatggccatcgacaacttaattctgaacaacatgagcacatccctgtctgaaaaaggtcagcaagtccaggaaatgtggcctcccgcccctcatggtcaggcttctccttggttttgaaccaagcccctcttgtttcaagcccacatgttcttcctgctccccctgctcccaggagaaggttaagcagagggaggagggctgaccctgaccacggtgcctcaagcgtggggaggcccaacccagtgcctgtgaattcaggctgggtcccgtggcaggcggggagtgagagaggagggcaggactgaacagatccaagtggaggggcctttgaggcgggaggagagaggaggccggcactggcctagacaggccacaccgggaaggcagccttgcagcccttgttcaatgctgtgcttcctctggccgctctctcttccagaccacccgttagccgagcagctccccagcctgagaaactgcagaagaacaatatcaccaaaaaaaagaaactggttgaggtgagttaaacaatcacttgtagtctgatattgacgttctaagacatacctggtagacatccccatctgcacgtcccaaagacacagtcaaatgaaacggagtaggtcccttgggctctcttttgtcccctctccctcctacgtagcactgtgtcttccatcccagggaccagagtcgcagccactgtatcgtattcctgcttcccccagccctgtcaccaggtcctttcagtactaaatctaagatgtcctgtgtccctcaagcctggctccgtttccctccacttggtcccactcagaccctcagcatcccttccatggagaagaaaggaaagagacaggggagcacatattcaccgtctctaatgttgcctgagccccgactgtttgccgggtgccctgctccatagccacgaagcgtttcatacaatcttcacacacaggagggacgcaccattactgtttccattttcccgacgaggacgctgtggctgaggggagttgagggagttatcaggtcccaagcccaagatcaccaagccagtaagtggaaagggatttgaactcaattgttgagactaggctctcataaagtcagaggcctcctgactgttctgcctgacttcagactccaccctctctctctgacacatgccccaatgcctccagagttggttttttaaagtatacatcttccatgcctcatgctggccttcagacctgggagagtcccacattgccaatgggattcaagttcatggtttcaaaaccttacccagagccaccttctaagcttaccgcctatgatttttcaccacagtgcaaatctctggccccccaaacccaccgctagtgttctcggaagctgcctgggactttcaagcccctgtgttgtcattccttctgcttagaaggctcctcctgccagctcccagtaccctggtctttccaagaccttctccagtatcttttctgtagagtctttcctgatgcttctcaccctaaaccttcctgcagttccctgcccacaccccatccttccacctgcacagtgataggcacagaggagctgcctgagaggtctgtgttggattaagaactgatctgaatcagccactgttctttgtcttagaagacaagacaggaagatgagaaagactataaacctcaacagtatctagtttttgggggaaaaaaatggcaaatatgtagcaactttgtagagcaagcaccaggcagcagaacgagcatggcctttgactctatgttctgctctacccaccctggtcacattgatgagagtttattagagcaaacctctgagccaccattcagctcacccagagtgcctgccaaggcacagacacaaaactgctaggtaccctttacagggcatcaaatctctggactttggcacactgacagagccaggaagtaaatctgggttttttggaaagtcatggtgattctgtgtgttagactgccaccccagcatttcagaaaactaaagaaggggctgcattttctcctcagccagtcaagaagcaaaatgttttcagtgagtgtgtgttggcgtcaccagccataccgttcctgggacacacgaggctgctcacgcaatgtgggtgtgttcctcggctctcccttccttcctctgagggtcacattgatctgtgtgtgtgaatgcaggagctggctctagaccacgtgtttggctacagaggtttcgactgtcgaaataacctgcattaccttaatgatggcgctgacatcatcttccacacagcagcggctggcatcgttcagaacctctccacaggtaaccgggggttaaaaaatacaggtttttcttttagctgttttttacatgctttccccactctttagatgcccaaaagcttaagcattttccttcccttatagagccattccccccaattccagcatggtctcagttaggcctggtaacgctcaggttcagttaccagagtcagagccttctctctttctgacctgagcttgacctcacctcatcataggccctagagagaaggcggccatgttgacaccagcctctgtaaccgacagccatggagaaaagcaagagacagggtgtaaggagtggagaaattccttggagaccataaccatgaagaaatcacagaactttgcctattcatttttacaatgagctattttttaacagctcagatttttcaagttgtattttgacagtttagccacatttataatgagaatgaaaacaattaaacaataaacaaaaataccaggcccggcaaggtggctcatgcctgtaatcccagcactttgagaggctgaggtgggcggatcacctgaggtcaggagttcgagaccagcccggtcaacatagagaaaccccatctctactaaaaatacaaaaattagccaggcatggtggcaggtgcctgtagtcccagctactcaggaagctgaggcaggagaacccagtttgaggttgcttgaacctgggaggtggaggttgcagtgagccaagatcgcgccattgcactccagcctgagcaacagagggagactcttatttcaaaaagaaaaaaaaaaatactcaaaccacatggtgactcaaattttaaaaatgaacatttcaaacaaaaagaaccattcagaaattaacagaaaactatatcattaccaccagatttaaacaggttcacattttgccttatttgctcatgcctcaagaaaaaaaaaaaaacacctttcattttaaatttttgttctttgtcaattctgtgtagttgttcatacatagatttaaacagtgaaatcactgggcacatgttgatttgtgtgtatctgagggggaggaggaccttgacattgtctatatattttcttcactttctagccttgccatcatattggtagcagtacacaccttccttgtgtatctacaccatcattcatctttaggttcttgagcatttgggtgggtttaaagtggctattatggaagtcagcaaacccatttgctttgatagatggtaaagtgctctttcttccacttcctgtgacatatgtcgagttagggctttccagggtaaagccatcacctgtgctgtccaggcccccaagtggattggcatttggtgagcaaaggtgattagtccctgagaatttcatattccacatgaagaagtggtaccattttgctcagtaaagcatcatctccaggcctccacccctacttctgcccagatgtggacactgagaagcaccagtcctgtgccatggagtggaggagactttgaccttcatcattgtggactctggaaacccctgtacttgaactgtgctctggacccacacagagttgtgggaagtatcgaagagcagcttgagtgtatcagataacagacagtagctccccttctcccagacccaaaacagaatatgaacattccaaaaaaacgacccttcatctccccaagtgtgattctggaagtgagaatttgagggctgtaagctctcacttttataagaagtatccaatggctccacgcgatgttttgaagttgccctaaaaggtctttaggttccactgttcaccctcccatgatctctctcccccagggagccagagcttctatctggagcacacagatgacatcctctgtctcacagtgaaccagcaccccaagtacagaaacgtggtggccaccagccagataggtaggaggtcctgtggcagctgaggctctcccagcttgcagggacgctgacctgtcagcaattattgggagagggagtgggtgggttgcttacatccatcccttcttgttgatgttgctgttgattttttgagtcctgagtgtatctgtgtcacctgcgttgacacatccagtgactgtgattctgagggaccataaagtctgaccagcgcctgagagtccaaataaacgttggcccccatccctgtggacttgtaagaatagtttttcagaccccaagtgtcaagaactccgtgtcttttgaagctggttattgtgcttggccagggtaggtttcagtaagtgtgcctggaccccctgtgccctgggaaactgccggtgacaaatgtgaactgattcacatttatgagaagtttgttttcacttagtcatctcgagcaatttttacaacttcctgcttgttttcattgaatcatgtccatttttaagtttaatttggaactttctgatgctggtgttgagtgcttcactgttggaaacgtgacttattttagctattgttttcccttgacgcttcctcattgccattgctcacccaatgcaggtgatattacggaaaccccaggtaaggctgttccatccgtgagtagtttgaatctgcagagcaaaatcatgtcattctatcatgtttgctgattgtatcttgccgaattgcagatacaaatcattgacctcaccagtttccttcgtataaaatcctctgcaagtgtgtgtgtgttgaacataaatgtccgtagggctctgcctttaaaagcaaatttcctctagtctttctcctctggccaggtcaggctataggtctcttatgcccaatgactgtaacagccctaaacatttgtcttaaaaaaggcttttgcaggccgggcggcagtggctcacatttgtaatcccagcactttgggaggcgggcggatcacctgaggtcaggagtttgagaccagcctggccaacatggtgaaatgctgtctctgctgaaaatacaaaaattagctgggtgtggtggtgcgtgcctgtaatcccagctactcgggaggctgaggcacgaggatcgtgtgaacccaggacgtggaggttgcggtgagctgagctggtgccactgcactctggcctgggcaacagagcaagactctgtctaaaaaaaaaaaaaaaaaggcttttacatgaacataagcatcgccttggctctgccatttgtcagccttacttctttgtcatgcctctccacactcagggacaacaccttccatccacatatgggacgccatgaccaaacacaccctctccatgctgcggtgcttccactccaagggggtgaattacatcaacttcagtgcaactggaaagctcctggtgtcggtgggagtggaccctgagcacaccatcactgtctggcgatggcaggaaggtaaaccagcactgggctttctgtccctccagggtgtctgcctgtgggtgtcgagcctgtgggctcgaacccagatctgcctcactccgaagcctgccgtaggcactgactgctgctgggcaagtggaaaacagggcactggggatcctggtatagctgccccactgatgccagtgcatcccagggtcccagggccaggaggaggctggccagggactccagggcccattagtgaaggggctctgaggaggttccccgatgttggcagccctcctcctcggaaggcagcagcctccccgacatctgtcttagccaccttcctacccaagggtccttgtcttccgtgctctttctgatggcccctggatcctactacagccctatcactttgtctgctttattttaggaaatgggatcatgttttatcatagtctcagaaacatttaaattttttttttaacattttaacacttttgaaatagggatttatcttacaatccaggtttacatttactgtaacaggatttctttctagtcctcccccaatacatgcacacacacctcacacacatgcacacacacaagctgcaactgaatgtgtggtcatcttagaactaaagatgtgcagtcctcctcatatattctcaggttgggtactgccctggcaagagcagatccaattagtcagaacattaatgaggtctgtctgcagctaggcagcctgtatctgggacacgctctaccaggcaagcgcagaggtgtcacttctcccatccagggctctggagtcccattatctctgcatcttcccatggagggggtggtgcgtggaggttgtaaagagatcagcacactgggggaaagttccagtcactcctgagcacccccatatgaggaaaagagcctgacagcttgcagacatttgtaatgataccatattccttcagaaggtgacatgatctataatgtttctaggaaaccacatgttctcattctctggttcaccagtatatctcacccagatggctgcacagtcagtatcccaggggtgcagattcattccttgtgatgtcaagtggccaactgattgaccagactcagcccagagaaattgagcatcttaaatgatagacagagagcatcttggagtgggaagaactagagaagacttcctgcagttaggacccatcctaaggagaaattccttcaaatgcacccctttgtcctttcaaggggtgtggctttcaaggaccccttgaatactttcaaggatgtggctctcctcacttcacaaggcagcccacacgctgtcagaaagctcttgcgtaaagccccttcttatgtggggacagaaattgcttcattatatgtttcttctgtgctgctaactgttcctagatccttggaagaaagctctcacactggccccactgcacggccttgtctttttaggttcaggctcactgtcttcactccctctacctgtcctccaagcagtgcctgctttggcctgccctagcacagactcttgctcacccagggtcccttctgacctcccaggggaaggttagaggagccagggcttttaaacaagctcccgaggaaaagaggagcctgctcttgtttgtacagagggttgtgagccagtgctgatatgtgacctatcgctagccaccacctcttccgggttgaccacggacatgtcatttctcctcccttccttctccagtgtgggtttgccttcatttcaagtcttacttacagataaatagcatgtgtttggggaggtttacatacattttatgtatcactagagagcctattattcattcttcatttattagaggattgttttggggaacgtgtgtgtgtgtgtgtgtaggtaaaaataaaatagacctaaaaatgagcttattacataaaatccatgtcgtcaggtcctaggtatatgtgtaatttgctctgagcagactagaagccaatgcagagagggatacaggtgtctccacaattagaagcgtccatgaaattaaaacaaggaaaatataaacagtggctttgaaaaaatgtgcaactcattgtttgtttgcacttctcccatgactggtgagctggaatctctttcctttgtttgcacttctcccatgactggtgagctggaatctctttccatctcattggccacttgtattggctgcttttgtaatctacctgttcaaatccttttactacttggagtgggagggttgtcttttacttataatttgtagttccttatagatctctaatgttaatcctctgaatcttataagcattgcaagtgctttcttcccgtatgttgtgttactttgtttatggtatccttggagactgtgggtcttaaaacctctgagccctaagtagagagagatctgctacagtaagtcagagattccatatgcagagagaattacagctgggagaagttctctgtgggtccccctagcctcgcctggaaagagattctgttagggagtatcagaggggtggccacaggcccagctacatcaaaacccaccaccatcatggtactagaaagctgtcataaaaacaaatgcgaagtgatgagaacgaagaagaaaaaaataggtgtgtgaataatcaagggaggggtgacaagaaatcggaacaaaaacattcagagtaagttaaagggtaacaggtttaaaacaaaaatttaaaactcgagagcttaaaaataatgagattaaaaaagaggtgagtttaaaatacaggctaaaagaatagaagccaagaaattttaaaagtagctaaaggagtgatgataatactattactactactactaatactggctaacacatgatcactcagagtatcaagcactgtgctcagggcttcacttacttcaattctttttatctgcactgcaccttctgaaataggaacaattattagccccatcttacaggtaaggaaactaaagcacagagagcttaaataatttgtctaaagttgttctacaagtaaatggtagagttggaattttattaagacaaaggttaaataaaactcaggagacataaataaatggggttaaggaaaaatagtacttaaaaggtaaaaaaatttaaacctaaacaccacaaactaaaaaggaaaacggggaacttaaagaaaatgcaggagaatcttaggaaaaaaaaaaaaaaaaaagctctctagaggaatgtgagtcccagtggccctctgggagcggctctgtcatcctgtggggggacgactcctgtggtgatgctggggacttgatggaagggggatgggggatatctttaagccactttgctgccttctcatatctggaagcttccatctcacaggccatcctttcttgctacgttcatgaatgcctgggttgggggatctgttaccagcacctgctgctctggaaacttgccagacacactttccccgctgccacctggggaatagtgtctgaaggggagagagtgctgtaaagaagaactgaggcatggcttacgcctgctggggtggagacctcctgggctgcggctcccccggcctggcccatgaagcaatgaggagcctcactggactctgtcacccacacaggtgccaaggttgccagccgagggggtcacctggagcgcatatttgtggtggaatttcgccccgactcagacacgcagtttgtatctgtcggggtcaaacatatgaagttctggaccctggcaggcagcgccttgctttacaagaaaggggtcatcgggtccctgggagctgccaaaatgcagacgatgctctccgtggccttcggtgctgtgagttctagcagatactccctgagaaggggacccagaccccctgggcatgggcatgggcatgggcaggaggggagtttggccaagaggctgaaaacagcaggaaagccatttccacattcgctcctgtactggcttatctgcaaccactgttccttttctgtagcacatatgggtgggttggcaacatacatatatatattatttttctgagacagagtcttgctctgtcacctaggctggagtgcagtggcgcaatctcggctcactgcaacctccacctcccaggctcaagcgattctcctgcctcagcctcccaagtagctgggactataggcacctgccaccacgcctggctaatttttgtatttttagtagaaacagggtttcaccatgttgaccaggctggtcttgaactcctgacctcaggtgatccgcctgcctcagcctcccaaagtactaggattacaggtgtgagccacctcgcctggccaatattttttttttcttaaaatattaaccagaaaaggtaggacacccacccaggacaggaggtttgttgttctaaaggcaaccctgagttgcaagccccagaggatattgggaacaatttccactgtagataatgatcctttttcttaccagccctcttgtgccacagatgcccccaattaccacccttaagtgggctatggggtgccctcagccaatgcaagctccaacttcgtggtcctccaggagtgggtttctccctcttgtagaggagccctaggaaagtgtcctttggcctggagtctgccccatccctgctgtcacttgggccatgcttacagaagggaagtccttgctaatgcacagctgtgctcagaggggaagtcagatgcccaagccagttaaatatagtgaatttccaagccaggtgactgccttgtgatgtgctctcggtgatttctttgcaaattctgctgctttccttagcacaaagagatcaaactgcctaggctgtctgcatctctagctctggttccttaatgagagaacgggtggctggggagggacccgcttgagtgtgttccgggtgtagaagatgttgttttgtttacagaacaatctcactttcacgggtgccatcaatggagatgtctacgtctggaaggaccacttcctcatccggctggtggccaaggctcacacaggccccgtgttcacaatgtacacaacccttcgggatggactcatagtgaccggcggaaaagagaggccgtaagccaaagctcctatggaaacaacttgtcgtttgttgttatcttgggagaaactgacaaaagtgttcccaacttggagaaaatgcagactgtcatcctcctatcttttttgcattaggaagatcagtctgctctctctccaagagggccctaagtcaagatcctcacaaggaagagaggagtgcagaggtggtttgatgatagtttaaaaacctgagagaggcatggtggttcacgcctgtaatctcagcactttgggaggccaaggtgggcagatcacctgaggtcaggagttcaaaaccagcctggtcaacatggtgaaaccctgactctactgaaaatacaaaatttggccgggcatggtggtgggcgcctgtaataccaactactagggaggctgaggcaggagaatggctggaacccaggaagcggaggttgcagtgagccgagatcatgtcattgcactccagcctgggcgacaagagtgaaactccatctcaaaataaattaataaattaaaagaaaatcttgagaggtattcttgaacaaaccacagtgactttgctgttgataaaacgttattcttagtagctctgtggaggaatggaggaaggaggagaagaggggagatgcagaagcaaagcctgaagacaggagaaacatttctgtgttctaatctaataaaaagtctgaatttccaaattacgttttctttcctcccaagatagtagcatttgaaggcattttaggaaatctgcaagctcaggaggttgggattgcttagcaccagggcctaagagagaggctgcctggagggtctggaccctggagggtctttccttctgggccccaactggccagaaccctgatgactgggaaagaggggagagggccggaggggtagtgggtcttaggatgagggttaacagcctgagtccctttcaatcttttttaggaccaaagaaggaggtgctgtaaaattgtgggaccaggagatgaagcgctgccgggcctttcagctggagaccgggcagctggtggagtgtgtgcgctccgtgtgccgtggaaaagtgagcacagccagctcccctgggggctgggccagggaagggggaagtgtaggtaccctcccagccggcactttctctgggctggtttgtttactccttgaaacaaggcctcaatacatgaattgtgctgtagtgggaagcagcttaagagagtcagactcccccaggaagaaccagctgggtgaccttgggtgtgttccttaatgtttttgtgtccagcacacaggtttgtcatgaggtttttgtgagggtcacatatttatacatgacagtgcctttcatcttacctggcatatagtcccattcaggagatgttagctactagtattatagatgatatcctcataagctcagagatactaaatagtttgcccatgccctaagctatagggccagtaaggaggagggtaagggccaccaaactgtctgactcaaagccattggtttccaactcatatttgggtagcgtatcaaaaacaactgtcgggttttaaagaatatggatgtccgggcacccacctggagctggtgaatcagaatctcaggagtgggacctggacctgtatgtttccttctatttccttctatttaaattcccccaggagatttgatgcacttaaaagccaatctccaaacttctattgaataccttgtgtttgtttttaaatatcagtctaagaatttgctttctagatgctgtccatgaaaaaggcaaactggatatggagtaccacatgattcaaaactggggattttgttcttaaatagctaagtgatgcccacctggaagggtagttatgggagatgaaggcaggactatgcctggagcctggaagttatcaggaagtagtttttttttttttttttttgagacggagtcttgctctgttgcccagggggagtactgtggcatgatctcaactcactgcaacctatacctcttgggttcgagcgattctcctgcctcagcctcccaagtagctgggattacaggtgcccaccaccatgcccagctaattttttgtatttttagtagagatggggttttcccatgttggccaggctgttctcaaaactcctgacctcaggtgatccacccaccacggcctcccaaagtgctgggattacaggcgtgagccatcacacctggccaggaagcagatttttgttcagtggaaggaagaacttactaagagcttgagctgtccaagaacaggagaattggctgctttgctctgcagtcactggaatattctggcagaggctgggtgatggaggagtctgtgctgaagctctcacctgaggtagctgatggagaaagggcaaagtaagagggtggagaagagcaattaagaatggacagtttgttgttaaaaacaaaacactggccaggcatggtggctcacacctgtaatcccagcactctgggaggccaagaggcaggcacatcacttgaggtcaggagttcgagaccacctggccaatatggtaaaaccccatctctactaaaaatacaaaaattagccagatgtggtggcgggcacctgtagtcctagctactggggaggctgaggcaggagaatcgcttgaacccaggaggcagaggttgcagtgagccaagatgtcaccactgcactccagcctgggtgacagagtgagaccctgcctcaaaaaacaaacaaaaacaacacttctcaccccttcttattttaatattaacactgcaaaggcattttctcaagttacttgttttttttttttttttaaagacagggtctcactgtgtcacccaggctggagtgcagtggtaccatcatcatagctcactgcaacctcaaattcctgggctcaagcaatccccaagtttttctaataatagtggtgttttaaatttttttaactgtggccaaatagacataaaattgaccattttgaccatttgtaaatatacaattcagtggcattaggtgcattcacatgttgtgcagccatcaccaccatccacagaacttttcttgcaaaactgtaactgtacccactgaacactgactcccctgtccaccacccccattcaccggcagtcatcattctactttctgtctccatgaatttgtctactctagatacctcatatgagtgcagtcatacagtatttgtcctttttctaatagtgtttcaattacaacagggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaaggtgaggccgactctgcccaaactcagatgcccacgagtgggctgcgcggcagtgggagctgagcgaggagaggcccagccagcgtcatggcagagacggggatggggccaggtaggagatcgagttagaaaacctaacgataaaagaagccccactcaccacaccccgtctaaacaatataattgagaaggattattctgttgtcatgaaagaacccacaaaactaaaaatatagagacaaatcatgttttccctggatgagaagactaaaaatgatttaaaatgtgaaatgttctgaaatgggcctaatgtatttctgtcaaaatcccaacaaggtttctcttagagcttgggaaggcaatgttaaagttcatctggagtaaaactgtgaaatagcaaggagtggctgggcggagcggggtgggtgggagggaacaaagagttcttgccgatcctcatggccttatccagtgttaaaacaagtactcaagttcaactaattaaaatacttggtttcattttaaaatggctggtaagtgtttgttgtatttttagtgtcagagtcacagaatagtcaggtaaaagcttgagtatggttgctagacttttaagttagtttctgtaattatttattaaacattattagcaacagctgtcactacttgactaactacataacaccagctgcttcatggacatgatcagtgcctacaataaccttgcaaaacccttattaacatcgctattagtaaaactctaaaaactgagatgtaatttacccaaacacacccagctagtaagtgacagggccaggattcagaatttgaactagcagaggcagaagctcacactctttcccctaaagaagaggttggcaatctacagttaaaggccagatcgggcctgtggcctgtttctacaagtccagctgccctcatttattcaggtactgaggctgtcttgtgctacagtggcaaaggtgagtagttgcgacagagactatggcccacagagtctaaagtgggtgctacctaatcatttacagaaaaagctgggcagcctgtgccctaaaacttgttgtcccccaagctgctctaatcaagacatacagctctgctcagttattcagggacatttactctaagaagcaagagatttggtggcctgcagtggctgcgagggcagcctgacttctctggcctggtgcagaatgtctcctggagaccagctgagggggccaagagctcaggtgactttcctttgcatcaatgtagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcaggtacctaagtgggtggtctgggcatggaggagaaaggcaagcattctgcttaccagtggttcccattccagccacggctggaataaagaactcagttgtgagagggtcactttcaacaagccacctatgaaagaataccttctcccactctcactcttagacaagtctttgctaatttccataaaagtgtggttaaaattacttgtaaatgtcattctacatatttcccggggattcgatccagataaattgttgaattccgtagaatgccaggagaggctgaccacatgtgagtcacaaggtggctctcattgcctttaggcctggaaggcctgtcacagaccagccttcgtgcctgaccagccccaaacagccctcctcatggactctgctctcggattgctttttctagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcaggtatgcttggggtttacttatatctggggcaaccaataataacagcagtaataacaatggcctatattaatcgagtccttactgtgtaccaggcaatgtgctaactcactcttcaccagaactccttaagtagttactttttccatattttataaatgtagaaacagaggcttagagaatttaagaacgtggaggaaatagaatttaaaataataaagagtaagaaaaacaggaaacacaagccctaatcatctttaatctgcccctcaccacctcctcttcagagtttcctgatttctagttttctggggctacacctaagccttgtgccgcttctggtatttattcatgtctttcccaactctactgggtagaatggcccctccatacgtgggccctggactccagccagtgggcctggagtgaaagctcatccctgggtcccaggggaactgaccggtggaagggagggagagggttccactgctgggactgatccctaaaaacagaatgatttctctagcactcaagaaatctgcgtttgtgagctggcctggagctggatattcactgtaaaaggagagaggatgtatttattcattcaactatttgctgaaccgggcactatgctagacttttagatggacaaaatgagactggtcccgtaaccacccaaggggttcaccttgccggctgcctagacagagcccatttctcaagacaggggaattgcaatagagaaagagtaattcacgcagagctggctgtgcgggagaccggagttttattattactcaaattggtctccctgagcattccggaagcagagttgttaaggataatttggtgggtggggggaagccagtgaaccaggagtgctaattggtcagagatgaaatcatagggagttgaagctgtcttcctgcactaagtcacttcctgggtgggggccacaagatcagatgagccagtgtattgatctgggtggggccagctgatccatcaagtgcacggtctgcaaaatatctcaagcgctgaatttaggagcagtttgagggtcagaatcttgtagcctccagctacatgactcctaaaccataatttctaatcttttggctaatgttaatcctacaaaggcaatctggtccccaggcaagaaggaggtctgctttgggaaagggctgctaccatctttgtttaaaccataaactataaactttctcccaaagttagttcagcctacatccaggaatgaacaaggacagcatggaggttagaaacaagatggagccagttaagttagatctctttcactgtctcaatcataattttgcaaaggcagtttcagtccctgcttcctggagcttgctctataacagagaagacaagcactaaacagacaatcacaaaatataaatataattacaaattgtgattatgtgccaagaaggaaaagtacagcattccggggagcatgtaacaaggtgctgaatttagatgcacttcctctcagcaagtgatatttaagctgaggtctgcagggtgtgtaggtgttagccaacagagaggtgggaacattgttccaggccatctgcatgaaagccctgaggcaggaaagagctcagcttcccagctcattccaggagaagcactgcagggagagaggaagctgaacaggaagggcagcagccattcactgcaaatgtcttgatggtaggaaaaatggtctgtttcctttagaagactcccagagcaccgaggttcaggttctagacacctcagagatcatctgtgtcacccactgtccatgagaaacctgccttacctctgtaccaaaggttcttggtttcctgtgaactgggattcctgtgtatcagaaacacctggcggctttgttacagcagagactgctgggccccaccctttcggtgtctgtctgggtaggtttggggtggggcccaaaaatttgcatttctaacacatttctagatgcagctgacgttgctggtcgggaaccacactcagagaaccgctatcttaggactctggaaaatagcgagaaaatggatgagaagaaagatgggaaaatggcctgctgttgttgtcatgggctggccataggctttgcagcctggagctgagcttgggtttggagaaaagccctagggatgcagaggctgggcagtgttctgggaaactgtgcccaaagggagtctgtgggactgagaaagaacgttgatgaacatggcttcccttctacctacaggtgtcaacaggtgcctataagcgccaggtgcatgaggtccccctggggaagcaggtaactgaagccgtggtcattgagaagatcacctgggcctcctggacaaggtgactgactggaagaaaaaacttgaggaaaaggtcacaagggagtctcttgtctcactcaggctcagcctccaagtctgtgcaggatctgaagaagctgagaaatggagctgtcttttcttttgggggtgagggtgggaggcttcttggctagtctagtttaggtcactggctttgatctgacctaggtttttgaaatgcgaagcccctctttttgtgtaatttcttctacaagtctccaaccccttccagcaagttcaacaggaaaccatctcccgtctcttggccaatcctagtgcacagtgaggcctccattcgctaggggaagggagtgggagggccagaccccggcttagcaggatgagaaacaatggctaattcatgggaaaagagaccatttagtctgtgagttgaaaggaacccctgctgttctccccaacacacacatattcaagaggaccacagggaacagggagagaatcaaagatgggggtaacttgtgtttttggagtgtagggaactgaggcagagggggaacagtaagagctggcacaaatgtacagaggggaaggggacagatgctttcatgccaggagagccacatggctgtactgaattacataaaacagcaccagggaccaatttcatggaatacaatttttccagagaccaggtagggggtggggtttcgggatgaaactgttccacctcataaggagcttgcaacctagatccctcgcatgcttagttcacaatagggttcgcactcctatgagactctaatgctgcggcagatctgacaggaggcggagttcaggtggtaatgctccgccaccactgctcacctcctgccctgcggtcggttcctaacaggccatggaccagtaccgttccgtggcctggctgttggggacccctgatgttaaacatccctctcttccttatccctgggaggtgatgactgactgcaaggagccttcgccgtgacttccttctatcctaacccctctttctgttggaacagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgtgagtgttcctcagagtaacctccctgcaggttctctgtttggccgtctgcaggagataggggccacgtctagatggccctctgggagacacagagaaaccctgtcccggtacagtggaaatatggcaatgagtttttcacctcctggaggggcagtcctggaagccagaagggaggatggagggtggataaaatgacctgaagtggggcaaggatgagaggcaggaaagtcagccaaaggctggctaatagatgagtccagaccaaatggaagtccccagtgaaggaaggttctgggagcaggggatttgagtgctggaagtagtctgtggttgctgagaggagccagggtctcttagctgtctccattcacttttgctcacaggccaaacataagcgatacttcggtcactcggctcacgtgacgaacatccgtttctcttatgatgacaagtatgtggtcagcactggaggagacgactgcaggtactaacgtagctgacccagttcttactccacaggcctggccagctctccctccccatctcaggcatcccgtgggtcagcctctcccaggggcatgaggagggctgatgtggggctaataaacaggaaattccatgagtcctcatgaaggcaagtactttccaagataaggcatttactctttggtgactgtcaacccaatggttgtgactggagctgtcctgggatggcatgggcatgtgatagctactctgggcactgctgggggaaagggacaggtggatgacacccgagatggctgatttgagtagaagctcttggcagcccatgggcttttgtgcataatcaggaggttagaatgcaaattcatctatatgtccttttaagaactcccagttgatcaccagtgttgggaatttctttatttactctaaatagagtatagaggaacaggtctaggtcattctaactcactcagcttccccatttctgatgagcttcattgtagcatgaatactgggttctattcagcccaagcaaaactcctgaggggataaagatgaaatacaggccttctgatacttcctggtggtctgagttaggttgtaagaaaggcacctataaagaatctcaacccacttcccactcaaaagcactgtgtatttctcatggcctgcctgggagcccccatctccagcctgctgtgctggctacttctggcacttatagcccttgagatagtaccgccagcagctccctgtgaagtgctaacaccccttcaaagcagcaccaacccaattgtgaacaagctaggagtaaaagacgtaaatgaattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccagaagtcctcacggaccaacatttagcacagacattcaaactgctgaaagaaccaaacagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaa

SEQ ID NO: 364 - DNA, 73117 bp, Homo sapiens
ttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttttgccactctaaatatagcagaaaacaaaataaaataaataagataatctttgctgcctccaggtgccctctgagggacagacagctgctccagagttgttcatgaggacaaaaagcccaggcagcctggagacccagctgctctgggtgagccttagctcacttcctgtggttcctgggacttaccaggcccacccccatgcgcatttctccaggcaggttctgaggactctttggacaatttctctttcttctcaacccttcaatctcctaatccacccccctacccccaatattttcatagaaactaagggaattttggaggtgaaagaagtcatctagtttccagtgtccaccctccccattctacagatggggaaaccaaggcacagagagggcagtgccttgcccaaggtcattcggtgagtcagtggtggagcaggcctgaggcccaggtcccccagttcccaccccgttctgcagcccacccctcagtcggccttgggcagggacttcctgtgcgaggggggcacgaggtgggggggcaggctgctgggcagctcgtagccgtcgagcttgatcttgatgaggtgcttggccagcgcgaactcctcctcatcaagcatgccgtcgcagtcgcagtcggccagcttccagatcttgcccaggacgctgttgggcagcttggaggtcaccatctccttcttggcgttgacacctgatatcttgccattgatgggcgacagagtgtagaagagctcgtcgtagacgggcttgtctttggccacgacccactcctcctcgtcggcgccctccttggcaccctccccgtagccctggttgaaggggccctcggtggtgccatcgaaggcgccgccctgcaccagctgcgtgggcgtgctcgtctcctcctggctgatgaggttcatgaggggcgagatcttgttgctcagcatgttgtccactgcctcgatcagcttgggcttcagcgagtggaatttggtgaagtcatagttctcaagctgttcctgcagaaggacaaaccacaggatgggttacatgtggtctcttcagggggaaacagttgggggccactggagggagactaattctgccccaggcagacgtcccacccactactcaggagtgcactctttgggagcttcccacatccagatgtaccacatataggagtggttgttttggaacaagaaacaagtgtttttcctatggcagccaatctctgctggtggccgcatgagcgacagcaacctccgaggactctgagaaaccttctttcacctgcctttttaaaaatgctctagagttagtattctatttctcaagggatttcactacacacttcagccgatcttcatagcaatcctgggaggaaggaggggcaggcatttagaaccacattttacagagagctgtgaggggctgtctggcagagtcaaagcagagcccctgtctcctggctcttgactaatgctctctgtgctggaacacagagctgtgacagaaggactatgtttacataaaacaactaattaaataccttgttttcggaacacgtaaaaaaatgtagtgtaggacagcttcttagtggctctaacctcttatgaatgagctgagggcgctactcaacaggaaccccgtaggaccagccccaccaagtacggcctgaccaggggcacctgtgctaccccaggaaggtatcgaggcagggccacggagaccttgcatatacaacataatcatcatgaatccactgtcatttctaaaatatggacaaataagcaaaagctggaacttgtaagagcagggagtagggctggggagcacgagggaataaacgtagctggtaagcctgagtatcactggccaggtcaggacatatcttagctctacctgttgagtgaggcagcctgtcagcagacagagcagcagaagcacaggctctagagggggcctgggaaacactgtgactgcccaaccaggctggggcagactacaggatgccacagaggctctgtggatggcaccgtagaaactgaccttcctaccttggttctccttggttactccatccatccatccatccatccatccatccatccatccatccatccatccaacaacccacctgtccaactaatcctccaactaaccatccatccattcaaccaaccctccatccatccattcagccaacaattcatccatccatccacctacccgaccaacttttatttgtcatttactctgcaccagcccctgttctggggcttggggatacagaataaatatgaaaagccataattcctgctttaaatgagcttatgttgtaatggaggaaggatactccaattgtttaaaaaaggacttgacataacacagtgaaaaggataacatgaaatctataaagtcattagaaagaaaaaagccaagtcattaaaagggagagaggggccaggctcagtggctcacacctgtaatcccagcactttgggaggtcaaggtgggaagactgcttgagcccaggagttcaagaccagcctggtcattagacccatatatatatatatacatatgtatgtgtatacatatatgtatgtgtgtatatatatgtatgtgtatatatatgtatgtgtatatatatgtatgtatatatatacatatgtatatatatatgttagggagaggaagggaataatcacatcagatggctaaggttaaggaaaactaccgcctgtataaggagaagagctcagttgcccagggggacccctggggaccctcactgtctaaggagagaaaacacttgtttattgcaagagacaaactttctgtggctctgaactgcgagagttacctagagctttacatgacaggcttcaaagatctgatgaaaagtgtcttcaacagtagttttattaaataaatgcagaaatgttccaggtatggcaggttttatatgtgaagtatttctgtatgtacagttctagagggggccaaagagaggccatgcaggtgtgcaattttctggagatgaggcagggagatttgcaaggaaaagtcagacctcgctgttttggacagaagcaatgtgacaggctgctaggaaaaaaaaaaaaaaacttggtgttatcataaatatcatgctttcttgtaaaaaaaaaaaacagaaaaaactggtaagcaaaactaaaaatttaaaataatttataatctcatcatctggcaaaaacctctgctagcatatctgggcatgcatttctagccattaacatacatacacacacacacacacacacacacacacacacacacactgaaacaataccacactcttaacaaataatatgtcatatatttctgtggtattaatttttacataacctttctcttaacagttacagaatattgaacttagactgtagagctgggccattcttaattaaccctgtcccctatagctggacacacaggttgtttccaatagagaatcaaaatcatggtctctagggtggcagggcaggaattctgggctgacatttggaaggggattcctgggtggtagttggtggggggacagagctgagaaatatcagctaaacgggctgacatttctctagggaagggactctgacatattctcaggaagtaaagtcagcagccatcaaaccatgcaaacccagcgtgtggcccctgctcagctcagagcagcgggtactgcaggccgggtctctcaaacgcagtcactagcatgtcactcctgacatcagcaccaaacaatgcggcctgcacttcgggctcctgccaccaacatctcaatgggccaaggagatggaaaagagaacgctaagcaggtggaggagcaggcgtcccccacaaaaatcccagtgctgctgggtcaacgagtttggattccccgggtgcgtgaacacctaccccatttccttaagaatgagcctgcgctcagagcgcacacagagcccctgtgtctggcccagcagacaaaggagggtgatgcctgcccaaacttcccaccagcctgcaggggccgtggattccgactgcagagctctggaaaactggcagggggagtggccgcatatttgcaggggtggacaggaggcagcagttattcctgtcctgggaggcaggcaagaaataaaccctccattctcatccctgtggtcccccccaggcttgaccggggactgcgggggcaccagttaaaccatcatcatgtcactcctgacatcagcaccaaaccatcatcatccctgccctctgccacggtgagtccaaaacagttcttattgggatgaatacacactggggaacttaaaggtatttgcccatcaacagttgtatccactaagccaggaccctggaattgctccctctcaagaggcaaaggtcagttcccagccccgtctctggtggggctgtcccttgcccattaattgccaacattaaccagaagagttttcaaatccaccagagggtctgagcagatggggctgactctgctgccctctgctgttgaaatgctgccaactcatgagctgaggggtccaaattctccttccagtcagaggagcagagtcagcagtaacggtggcccttcgggtgctcatcttgtcctgcagtattaacactgtgctgtcagtcacggtccctccccagagcgtgccaggcacgcacaggcagccacacaggtgggttgcagggcctgtcccagctcagggaagggccttcagaatacactctcctctcactgctacagctaagagtcactctgaccagctggctccatgagagaacagggagaataacaacctaaagctggcatcagcgagctctctgcgtgaccctgatatgtgcaaagatcacagtgtggtcacttctaagcgtatgtcccccctctgtcaaggcctatgttacagaggatgttagactttaacagcctcagggatgggacaggccctaacccacacacgcgcccctcaaagcttccggtgacagcaagctagcttgcagtatcaggtgacactaagcattcctgacaggctccaggctgccttgttccttggggattctccgaaggaatggggtgatgtgactgggcctcagcctacttcccaaggaggcctcttcctgcagcttctaggggttggcacggggaacccctggtctataagccctgtgggaatcgaggctgcgtcagggcctgagagcctgctgtgatatggccttacactaacttactaattcacttggcttgtgtgaattgagcactcaccacgtcctagatgctggggatatggcagtgaacagggcatgggtcactgacctcatggagccacagacttacgtgggagagagatactaaatatcagacatcagataattcaattacatggaagcacaacagtgctcatattgtaacaagaaacatgtgtccttacagtggggttgctgtcaattatttttacccccatttgttcattttttctgttttttgacagggtctcctctgtcgcccaggctggagtgcagtggcgtgatcatggctcatagcagcctcgacctccgggcttaagccatcctcccacctcaccctctcaactggctgggaacacaggcatgagccaaccacacctggctaattttaaaatattttaatggatatcgggtcccactatgttgcccaggttgttctccaacccctggactcaagcagtcctcccatttcagactcccaaagtgctgggattacaggcgtaagccactatgtccagcctcatttgttcatttttttgtgttgatttattccaggggcctagaacagtgatagcagcaggaggcagaaaaatgctgaggcagataggggtgggtctccagtgaaaccctatcttcaagccaaaggcagtttaaagcctgcaggccaagctacaagtcaaatccatggactggattgagaacctgtctttccatttggctgcttttctttgattgatcctcacccttcacctattttacatatacctacccttccctaattgtttttacactgttatgtccacctttgactggtgcctttgttttaaccttttttgcatactcacaaatcaatcagcatgcactcctctatcctgtgcctataaaaaccccagactcagccacactggggagatgacctgacttcaggagagacaacccaatcttcccatcccctcttcactgagagttgttttgttgctcagtaaaatcctccaccctcatcactcttcaattgtcagcatgaccttattcttcttggatgcaggacaaaagcttgggacccaccaaacgcaggtacccagaaaggctgtaacactggccctctgccctcaccattgcagggtagccgtgccactcaacagaagcagtggtggggtcgagctggaccggagccatgggccagagtggggcaagagggtgactgagctgctaacatgatgcacaactaaaagagctaattagcacactgtagcaccccctctggggctttggggttgcgggcatccctgcctgggcactgccacgttccccttggggtgacacacctggtctggctgcagaccatgcacagagcctgctcctatgtcagcacttggagtggctggctggatcctgcacttgcttgctcacccaccttccgtggtgctaaggtactgggcatagacctgagtccaggtgattctcagcaaaggcttggccctccttgtaccctccatctcagtgggccatggctgctcctgagatcatgctttccttgttgccttcccccagctcagaggaccctgggtgtcttctgacctggccagcccaggctagctttgtcatgagtagctctggtcccagagcctgctccctacattatcgggctcacaggggaccagcaggagaggcctggcaagggaggcctctgtggagccccagggctcaagagcagcgtctccctgtggcaaggcactgtagcaacttcaggaagccagcgaggcacagaggccccaactgggccacagctcaggctctgtatttctttataactttcatttaggtcaagaaaccaagttcccttctgaaatatctgaagggtacaaggaaacagctgtcttactccttggtcatgggatacagggcataaccaggggtgtgaatggggaagttgcccagggagactgctcctggaggccacaacagccctccaataccacctggtgaccagaaaaacccaattcagcttgtgagcacaggaatacccatttcactgctggaagaaaagagacatttctctgttgtgtgtgcgtgtatatatttttttgagacggggtcttacactgttgtcctggctggagtgcagtggtgcgatcttggctcactgcaaccttcacctccagggctcaagtaatcctcctacctcagcctcccgggtagctggaactacagacatgcaccaccacacctggccaatttttttggattttctgcagagacggggtttcactacgttgcacaggctggtctcttgactcctaagctcaagtgatctgtccgccttggcctcccaaagtgtagggattacaggtgtgagccactgcgcccaggctctgtgtgtgtgtgtgtgtgtgtgtgtgtgtgtgtgtgtgtgtgtgtgtatatatttatttattttttgagatggggtctgcctgtgtcacccaggctggagtacagcagtgcgatctcagttcactgcaacctctgcctcccaggttcaacaaattctcctgcctcagcctccaaagtagctgtgattatagccaccacacccggctaatttttgtatttttagtagagacagggttttaccatgttggccaggctggtcttgaactcctgacctcaggtgatctgcctgcatccgcctcccaaagtgctgagattacaggcatgagccatcacacccggccctctgaatatattttaaaataaatacagctaaagcatattgggtcagatcaaatatattagactgattcactctgaatccaggtgtaaagagctgtcatcaaaacagcaagaaaaacccacctctgagttagtgtataatttatataaagcttgcattaaaaaaccccttaggatcaaagttcccctctcatcacctgctggcccttgcctcttctgcccgaccttcccttctccctgtatcctctctgctttcacctttccctcctcctgcctcgggctgtacctgcttgcagtttttaatctatgctggcttcaatgctgtcactctgtggctcaaggcaaaagatggtaactggtggtctctgtgtgcagcccatatgcaggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggcccccagggcagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtccagcagcgtccgcagagccccacagcccctgctggagcccttgagcctgcagcagcaaggctgcctgagcacataatcccacggcgtgaggcaggtcagggcagggctggaggaggccgcccaaggtgaccctgaaggccactcccagctgtgattccctcacagttctgggattccaatgtcaccgcaacatcaaccagcctccttggacacagtctaagagggctgctcacctgactttctcatgggagcttcatttacctttggccatgtgtttcctttgtttacgcattttggaagacaggcaatttctgctttattcatagcctattatcatggatcaccattaggaagatgcgttgtccttgatcctaaaccatgggactctcatttgtctccagcaaacagccagacaatgtggcactgcacctctgccctctgcccgtgacattgtagtgggctcccagtacctgcatagccttgacctcagggaagtcccctgcagaaatctggtattctcgctgtagctgaatgtagatttccggtagcctgctgataagctctctcttcttgttttcctttccaaatacacttggcatctccttcttcaggtagctgatgatgtaggcatgcacctggaggggtatagatcaggcagggaagtgtcatttagaattgcatcagagaaggaacaaacaagattgcatcttaactccatcataacacataacaggtacccacacaaaccaggtcccaaggacaggaggaggggagggtccagggggagtggagctgtccaagggtggccggaatgtggccagacttggggaaattctacggctactgttctgttgtgcctctgagtggcaattctggtgtctgtagggagtgagtggtatgggtggggcctgggtgggagagctcttagttctggcaattaaccagaatacccaggagaaagtttcaccaggctggtgcctgggagcaacaggaaatgaaactggaggctggcatcaatggctgatcaacatggaaatctgtacccagtgaacgatgagatgagaatccccataacccccctgttatgggaggtttagactctgagatctctacaggtggaattaaagtcattctgcacaagaccagctgcctgggatcaggctggatggcagaagatccccctgggagaggagcccagaagccccagaaaccttgatcactggggcttggggtagccagcaggctgtcattggaggggcgagaatctggcctcaacatttccactcttctactgatttccaacttcaggatattaagaaatgttcactacaaaagttctctttgtatatatatatttttgagatggaatctcgctctgttgcccaggctggagtggaacagcgtgatcttggctcactgcaacctccacctcctggttcaagcgattttcctgcttcagcctcccgagtagctgggattacaggtgtgcaccaccacgcctggctaatttttgtatttttagtagagacggggtttcaccatgttggccaggctggtctcgaactcctgacctcaggtgatccacccaccttggcctcccaaagtgctgggattacaggcatgaaccaccatgcccggctactttgtatatcttgaacttcagagtaattgtgaagtcaagtaagtaactaaaataagaaaggatgaaaaacagagtggtgattacaaaaagaaaatgactatgtagcaacggaaaatcctattaaagaaaacagacttctactgtaatcttgtagaagttgaaattaaataaagggggtaagcagatacattccatagctcagctgagggcccgtgtgtggacacatgctggacacagccaaaaacattttgtgaggatttggatgctaacctaagtacctaatgcaaggtctgacatgctgaggtcagacaatgtcaacttcccatctgcacaagggtcgtttaacagaagcatgcactgtgcagcctggctaccgctgagaggatggtcttggagagatgacgctaaacctttctgtcaccagcaaacttgtttatgtacttatttttcaaatgaagacaattgaaatgatttacaagattcttagagataacttgagaaacccgaagtttgggatccgttatttagaatcctgggctttaaccgctgtgatgagcaagtggtaagataccaactcctttgcctccgacagtgaatgcctggcttggtgtgggtgggctggggagggccagggctgagggagcacccttggactggaggagctgccacgttccatcagggagaaccagctgctcaccagctgtccttgcatcatttccttggcctccaccttcctggaaattctggattgggcctatgagtatgttctctatgtatacctatgtatacctctctcttctgtgctcaggctcaccccaccctggagccaccccaagggaagcaggaggcccccacagctgctcagtctcccaaacacaagggcttcttattgagaccacccccttccctgctctggggcctagccctggagcagctgcctaggcctctgtagggcttcccaagagccctcaccacgtactagtaaggtacctctgagccgccaggccccagctcagggagggcttagttcccgctcatctggctgactcctcacccactccctgccgcccaccccccgaggttgggcacactgttcctgaacactccctggtgcccagggcctgctttacctgcactgaactcagctgatgtgcacctgccacacccttcacccactgagtgtcacctgatccctcgtctcaggcctcatggtgtttgctggctgatgaccgaggtggccccgacactaggccttcacagccctgataaacctggggctgatcttgtgccaggtctcaactccctcctccttccgccagcttggtgccacctgagtcatgacccttaggtgacctgctcacactgcagctgctctcggtcccagcctccacttctaggaagttctgttagcgaggtttgtggaagtctcctgttacgctgcctctgcatgtccacccgcgtcctgcccttcctggtgcgccctaaacaataacccagggccaacttctgtgcacagacctgctttcagaagttcatcaagttggccaggcacgatggctcatgcctgtaatcccagcactttgggaggctgaggcaggtgggtcacttaaggtcaggagtttgagactagcctggccaatgtggtgaaaccctgtctctactaaaaatacaaaaattagctgggtgtggtggtgtgctcctatagtctcagctactcgggaggctgaagcaggagaatagcttgaacccgggaggcagaggtcacagtgagctgagattgccccactgcactccagcctgggtgacacagcaagaatccatctcaaaaaaagaaaaaaaaattcatcaagtcacaaggtaaattataatccttagcatcatgaaatactgaatctggaagtgaccccccaatatctactttaattcctggttccaggacatccatgtgactcactcaaggtcatacagctagttggtagatacagagctggcactagcatccaagtgcctcgttcctgtccctaaagaactaatgactccctgtgggtatgccctgtgggtatgcattaataatcttactgaagttgttcaaaatctggaattcaaaatgaactgtgtcccatagaatgagtctggaaaactttgatctgaggtttgacttctgctcgtgcctaattcactgagaggctttggaagggtcctttattctccctttccccacacatcaaacacggacacaatgatggcacacaaacgtcgggacaccacgtgggaatgcgggtgaagactgcgagctgctggcaggatggcatcctgtcattttctaaagtcttctggtaaacagacgggacagcttgaatgactaaaatccacagtcagcctccagagatcactcctgcaattatgtgtcaaaggtgtctccaaatacatgccagacccagggccagacctggtggttgtccctggggaaggaggtggaaacacttgggtcttctgacctttataatgagagaaaactaattgggaagaggaggagtacgaaagagaagagggggactagacctggagcttgaagatgaggctcaggccccgtgaccactgcctacccactgagcaacttggggccaggcatggcatctccacctcagcgtgctcatccacaaattagaaatgacaacaacattcatctcacagagttattatgagaataaaagaggtcatgtatttgaatgcactctgctcactagaaagaggagcaaatgttaacttgttatcaactaatggccaaagaccaacagctggaggtacagtaatgagagagagggctcccggctggttactccttaccaaataattaataaactctctctatttaaatagtaatataatgaatttgggttccaagtgtttaatttacattgacccctgggggcttttgaacattcgtatcttgttcaagtcatcctttgccttgtgtaaacttgcagaagccctaaggcatctaatggggatgactgggggaaatcaaatggatcaaaatgacaaaatgacaatttttctctaggctaataactcaatgagcagaaaggaaagtccttccttttaaatgtatatgaatgtatatgtagttcacacgtacactctgacacagatctcattgtgtccaatgatgtgtgtgtgtgtgtgtgcctccaagactgagacacatgtactaaagagtgatactggccacatctactctgggcttggagggtaacttcagcgagtgctggatgctggaagcgaccagtgctggaatgaaaagcttcatggaatgtgaggatcaggcagtagtttggggaaggcgggctgggaaggcatggtgacacactgtgccacgctcatctgcaaacttaacgcaacctgctggagacctgcggctggaagcccagctctggaaacctgcatagagtatttaaagccagggtatcagcacgtttataaagtgggtttatgataatataaaaaattcagttaataagcctgagacccaaaagatgaacccatggggtaacaagagtgtgagactgtgagaggcagagaagggcagctgacttgagcaagggtttgttattctgctcagatcaaaactggcaccaatggcacgtgtaattccgtgcagccttaaaggggaccggagggggctgcacacttgtctgaggtcaaccttcaaagagacaggcttccatttatgggctcaagcactgacacacacacatccacagtagctcagggctgctgactgagttatttttagagccctgccgaggactaggcaataccaggatcttcatgatccattatatcatgattctcacacgctttagcctgaatccatttggtgcacaaaaaatgcctcatttctttacaggagaattttttttttttttttttgaaatggagtcttgctttgtcgcccaggctggagtgcagtggcacgatcctggttgactgcaacctccaactcttgggttcaagtgattctcctgcctcagcctcctgagtagccaggattacaggcgcccacctccacgcccagctaatttttgtattttttgtaatttttttgtaattttttttgtaatttttgtatccagcacttgctgaagttaccctccaagcccagagtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaactacagtgaaccttgaaaatcactgacctctcctcttctttctcagttttacttgtttcttcctcaaatgttgcctcatttttgttgagcaaagatctccaaatgggtgacagcctttcctattcttgggcaatacgcttctaaagggtggggtctgatagtgaacttgcattgtttgggatttgtatgagtctaatttctttaatttggctattttaattatagctgaataaaagtaaatgacatgttccaaacccttttttgggctttcccaaaacagcttcctttaaagaatcatgaaatgaaccctgattggcatctcagagtgtgagccgtcttccaagaaggatgtctactgagattgtaagaagtgatctttgaggctaaccaaaaacccactctaaagtttccctgttccttaaatacagagatgtgaaaaaaatatacaaacagaaaaagaagggaaataaacttcaagagctctttgggaagagtatctatctacttttcatattattaaaatgtcacctttatgacacttcgagtttgattaaaacggcgcacttgctttatctggatgggccatgaatcctggttaattatggtgttctataaataaacatactccacaacccaactcagacttgacatctcttagctgacatctgaaaacttaccctttgcatgttttcaaagtgtcagcttgataaacctaaactttgtagggtttctgtggatggagacttttatggaataaatagattaacagatcagtgcagaaaacaaggacacagggaggaggtactgtagctgctgttcactcccgatttcaggtgactgctttctggactgaggtgtcacactgaccgaggtttgaacgtatactttgcagcttacaggctgtgaagcctcggggacataacttcacctttctgagcttccgttccctcaggtgggaaatgaggacaaaaatgcccaactgtgtagttgtcaacaggatcaaacaaaaaaacacacataatgcagactacagagctttggaacagttggtgtgaaaaaggaaaactggatcaagagaaaggttaataaaccaaaataaaagcacttttggaaaatataaacactccaaaaagaaaaactcaggtaagcatctgtccatttaagcagaaacaagttcagcggtggaacatgaaactgcaggtggcgtgaggtcaatgtcatgagttagtggccaaggccgccgtgctgagtccggcttctcctccgggtgagcccgcttcctgtccccgttcctcagcatggcactgcccacgagcaactggcactgagaagctccggctgcaaatacccatacttcaaacattttcctttgtgaaaaggaacaagccagatactattcttaggaagaaaaaaaccacaagcctttttcctgcaagtaagctcagcaagtttgaccgtcccccactccctgcatccacacaagggttttcattattcacagtgtcagaatacagagcagcgttctgtgcctccaaacccaggccgcgctggcccgttcagagggcccgaggctcaaggatggcagggaagctctacgggttaaggcgcttggcatttccagcgagctttctgctccttatttatttatttatttatttatttatttatttatttatttgagacagagtctcactctgtcgcctaggctggagtgcagtggcacgatcttggctcactgcaacctccacctcctgggttcaagcgattctcctgcctcagcctcctgagtagctgggattacaggtgcctgccaccatgcctggctaatttttgtatttttagtagagacggggtttcaatatgttggccagactggccttgaactcctgactttgtgatccacccgcctccgactcccaaagtgctgggattacaggcgtaagccaccgtgcccggcctccttatttatttatatgactgaatacagcagcatctccagtcactgggtcttcatttaccaataactggtaaatgaagaatgtccatgagcatttaaaaatagttttaaaaaatctcaaaatctgcaaaggctatgacatgagtcaccaactttggttataaactaatgtggggtgtcacacaccttgaaggttgttcagttgtacctgctggagaaaggaaacaccacaaaccaagggatcaccgagtggaaaaacagccttcctgctaccaagcattaggcccaggacaagggcgagggcaaaatcatttcaggagagctgcacgtaagtggatttacaaactagttagcacatctgccttgcagaactggagcaaaaatggcttgtagctctggaaaggaagccacttggaccaggaagaacagataaagaaggatgactcacacaagcaccacaccactgcaggttagctgagccatatgggaggaatgcatgcacacgcactgggacacacgtgacagagagggacacaggacatcgaggtcctgtgtgaggggcagcagcagccaggacggtgtttgttttcacccaggcaagaggctgcccagtgagcacactggcacgaggacaggctgctaatgagcagcaagaaggaggaagaattgtccccaccttggctgtccccatcagggaagccctccctgcctcctggccaggcacgtagtcacccttcccagagcactcatggcagcatccataccatgactggcacatagccaatcacccagggagctttacacacacacacacacacacacacacgcgcatgtttacacacatgcatattcacacaaggccatgtgtgcacgcacacccctatatccgaggctctggggcagggcctgggaatgtatgttgcttctgatgatcagccaggtttgaacttcactaggactagataaaactctaaaggcacttccagcattagaggacaatgattttatgaaacatgcacatattttttaaagagccatttttttctctgtattttctcttggaggagggatatgcttttctctctttggagacatgaattgactctgtcacttgagggatgtcagcaggtcacctctcactgccccattgggcacacactcctggggctgctgaaaggctcagctatgaggcaggcgagccaggagcccaggcatgcaggctaacagcccgcagcccagaatgaggatgcgggggtgacccaaaaccagcacactccaagagtaagactgagccatacttcttcccagggctcccctggatccaggtggtaacactggcctttggtgcacggggactagcagtggcctctcagcatcctgttggtctcaccaatgccacctctttcaggtttggttggttatattcctatcgtcctgacatcctaacagctaccatgtagtgggtgcactgattgatccccctccctgtgcaccaggcactatgccaagtgctctgtcacactgaccaactgtcaccccaagttcttgtgaagtgctcttattagctccatggtacagattggagaacagggttagtcatctgcccaggagtgcagagccaggagctagggtgtcagcagggccacctgacctcgaggctgtattcttaacctagcgcatgttcattccttaagccttctggaacgaagcctcctcccacccatcttgcctctggagaggagacagcagagtcccagcccctggcctctgtgcaaggcatctcctggcttaccttggccagcctcgctcgcttgatgaggtcgttgagcttgcgcaccgctgccttctgggggaggctctggatgtctctaaagaggtcctgggcctcagcctcgaagagccggcggttgtccgtgttctgcaggggctgcgcccagaaggagccaatgtagacgcgcagtacctcgggcgtgttgatgaccttgcctagggaccacatgagggccccgtagacccgcatcagctgctgcgtgtccacttggtcggccttgttcagcacgacacggatcttgtcgtcctggccccggaaggccttgatggcctctgagaattcatctgagatgtccagcttgtgagcgtcaaagagcaggatgatcctgtccaccctctcggcaaaccactgcaggacctggcagaagtcatagcctgggtggagagaaggacacgtcagtgtagccactgctgcaggagacacgtttaatgggcggctcaggaacagtctcgctctccagcagctgccagggagagagccctgtctccaacctggaggcagtggaggcctggtgacatgaaaatcacgggctggatgaatccgggtgggaaggacctggggagcccttccacaggaggagggaggaaagagaatggggctcatggtcactttgggaattgctgactttcatatctgcgatttcatttagtcctcatgagtgttttatttcacctaatacagaccttttgcttgatggcagaattgatcaatggttttataaaaacacaggccatgggtcaaaagatcttacttctgaaaagtctcacttttctgaaagccccaaatacagaagaaagagaaccagaggccacctggcatcccatgggggtatccagtaagcataacagaagaggcatcgccttcaattaacccaagtttgtagagtgctgaggaggtcaaaggttggcccagccagtgttgtgatcaatatttatctttggactatttataactcaggtatattgtgaatatttttttaacattacgtatcacagccattgtgtaaaatggtctcttgccaatttctttttttaaaatggcctggcccacagcaaattctgtccagcctattctgaccacctccacaaatcatgcagctgcataaacactcttcagcccaaggtcaaggctctcaggcctttccccagggaggcagattcccacgaaaagcaaacaagaggaggccaagcccacaaagttgacttttaatctcagtctgactagttgcagaagcagagtctcaatccagcccagctagtgctgagatgtcacctgcctgacccccatgctaggggtcgtctcccctcttcttttagattttgaaaactttcaaacatacataaacatctgtaagtcatataatgaatgctgatgtacctaccacataattttaacaaatgttgacactttgctttgtttgctatttcagatatgttttaaaaccaagtatcgtttctttagataacaaaataccatacggtggtgagaaggaactagatcttcacttgtcaacacaggtaaatctccagaaaagaacaagagtaaaagcttagtttcaaaaggacatatacagcatgataacattcatgtaaaatgttaaaatacaaaatactcaaccatctgtggatacagactatagcacaaatacaaaaatgtcaacatcgattgtgagaccctggttggctgtgggggtggagaaggtgtgaatccaaggcagaggaaaaagtatctgaggtgaataatctattaggtgaaaataaagagggtctgcggactaaggtttccatgcatttgaagaacaggtgttagaggaatagctgaacaagcaaactggattcaggtccatttttcataaagaaaacaagacagttggtaacgctgaagccccctgtgcacccctccctgagcccttccccccactagcaggccgctgtcctgagtgtggtgtttatgccgccacacgcgtggatacttccagttcatgcttttcatttctctgttctgtctcactgcggcactccctgactccttggggataaggaagacaaaggcagttctcggaatgtgggccagagtttattttcattgctgtcagcagccagtttaggtcagaggaatatcaaagacctactgacagggtcacacatagtcaaggtttcactctgagttctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgagttgcttttgctgaatacccttcctgttgggtcaggaggtatcctttatgggttgtggaggctgaaggtgtggcagagagtccctcgccccattccttagcaagctggggcataagcatgtgatctagagttagacattcacttccttccaccagagaggagtgctgaaccttggggaaatgacacgaagacacagtgaaaataagaatttactcatggtggtggcggcttcctaactcttttctaagcctagttctccaactttcccattaatcctgtgacaaattctccaaaacattttcttttctgcttaaattagttagaatcagcttctttggtttgctattgaaagtgatgataaggctgggcacggtggctaatgcctgtaattccagcactctgggaggcagaggcgggaggattgtttgaggctaggagtttgaaaccacctggcaatatggtgagaccctgtctctacaaaaaataaaaacaaattaactgggtgtggtggcgtatgcatgtgggctcagctacttgggaggctgaggcaggaagatcacttgaggccaggagtttgaggcagtgagccatggacccaccactatactccagcctgggtgagagagtgagaccctgtcacaaaaacaaaacaaaacaaaacaaacaaaaccacaattggtaaacaatcctcccctcacccccatttaagatttcggaatacctcttactgtcggttccgaaagaaacctgccacccaaactgaaacacagctgctgctgctagctgcgctcgcgccaaccctgccgtgcttgtgccaacccagccgtgcagatgcagtctctcttcctcccagggccgcctgggttgaatggttacctttgattgcaacacttgtgtttaaactttaacttaaatttgagttcctaacagttaatttaagcatctttaaaaaagatgccatttcaatgctatagtgaaatcaaaagttattaggaacagagctgccagatttaagtttactataagtgacgccaatactcatgtctggaggaacaggtacatatccatattttcttgtgttaaagcaacaatgagagcttaatatagttcgagaagtacaggtaggcagagctgtgtttgttctgtccctgagcaggtgtaagaggacggtctgtcacacatcaggcaacacaatcaaaggagtagaaatcacagtgtccaaaagagagcaaggaatgatcaaagctgggagaggttggtctgcttaccacctccccctacaaagttaggattattttgctactttaagcattttaagtgtactgcacagtggcattaaataagtcacattgtcgtacaaccaccaccaccatccaactgaaactctgaacccattaagcactaattctcccctcctctctctagcccctggcgaccaccattctactttttgtctctatgaatttgactactctaggtacttcagagaagtgtccttttgtgcccggcttctttcactcagcacaacgtcctcaaggtccatctgtggtgtagcatgtgtcagagtctctccctcctcctaaggctgaataggtcggcttgattcttgtgtcatgaaggactcaggcggcaaatacctagctacccaaaaatcccagcggatctaactcccaacatgtcatttagtctgcctgctaaaggaaaacggtgattcagaaggacctagagaccactgatcctcaaagcctgttcctgtgttggaatgaaataaggggcttgctaaagtttagactcctaggcccctccccagagccactgaatcagaatccctggggctgagcctggggatctgcacttggaagcttcccaggtgattgcaatgcatggtgcagtttgaggatcactgtctagactgaataccagggtggggaaattgtacagataggtttatgttcctgttggttagcaagcaacaaagcaaatcaaacacatttaaagtagtattagttccttttattccaaaaagttaccaatagatgtttaggtggtgcatcacaggtcgaggaaacagaactgaaacatgcttatctgaagacagattttaaaactcacccaagctccctgcttttgcccatgctgggctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattacttcacctctctgtgcctcgtttcctcatctgtaataacagtgtcttggggctaccctagggctgataatagtatccacaggcctcaggagctgcagagttaatatacgtgaagcatttagaatcaccttggcacctagaaagctgtccaaaatgctatctactggttatttaaaaaatctttgtatccagtgcctggcatacaggggggatgcaagaaatatttgtgggagaagtgacagaaagcaggcagtggctgcctatgacgggagcccggctggtgagtggaacagacaaacagggagcgtctcagggtgatggaaagtttctatatcttgatgatggccatagtcacacgagtatgcaaatatgtcaaattcaccaaactgtacaattagatagaatagatgcatttttcacgcctgtaatcccagcattttgggaggtcaaggcaggtggatcgcctgaggtcaggagttcgagaccagcctggccaacttcgcgaaaccctgtctctactaaaaatacaaaaattagccaggctaatttttggcagatacctgtaatcccagctacttgggaggctgaggcaggagaatcgcttcaacccaagaggcggaggctgcagtgagccgagactgtgccgctgtactccagcctgggtgacagcgagggactgtatctcaaaaaaaaaaaaaaaggtgcatttaatcatatgttatacttcaacaaaattgacttaaaaagcaaaagtaaataggaagaaaagaaagaaaaatcccaaggctgctaaacttgtttaaagatacacatctccacaaactgctgaatggaccaggaagttgaaatctgttcatcaaggggctacatacctaagctggctgtatatggaggtgaacgaagctatagtagaagccttaagctttagaagaaatcggccttaagaaccactcgaagcggctaacctgcatcctgctttctggccaaggtgatgaaaacctctcatggtgacagaacaggagtgagaatgctccaagtttgtgagaactggtttcagctaggcacaatgcaacgtggcctggggcatggaacgatctggacctatgtgtgtttgcatgtactagtgtgtgttgtgggtgcaggactcaacataatcatagaatcatcccacggtgctcagtatattttcaacacttattcatgcaattaatagaaatttcaatcctttaagaccttccagtgaaacttgtattagtctggaacaaaaaagagatgtaatcagtccagttgtttcaaaatatagtttctttctttgccaaaggacccaaaagctacacagcttggggaactaggagaaagaatttgtcctgcggaagatcccagattggcattcctggctccatgttctgggaacaaaaggagggggcaggaaggaaggagccccttctacccaatcaagggcttcccgtcacagcccctgtggaaactgtggtcctccatcctggccagagaaagagccaccagggaatggcataaggggttagaacagttgctccctggctcaggtaaatatagcacgggggtccctgaggaagcaaatttggcagtctatttttaatagaacaagagaaaaataatgcttacatttcttttcagagccaagtttctaattatgagttttaaacaagatgtgtgtctatggccaggtgcggtggctcagacctgtaatcccagcactttgggaggccaaggcaagaggattacttgagctcaggagtttgagaccagcctgggtgagtgaggccctgtctctacttaaataaaaaaaacaaagaaagatgtgtgttaatgaaaggatgcaaggcaatggaaggcaggcagaaatgcagccgagctccccctgccatgtccctcctcccactcctggggtgggcagggccacttgcccgtggtggtgacggaacactgcctaaaactgctcaaacctctcctcttttcgaggccctgcccgcccctcccatagttagtagctccagttccatgtgggcattcctaccactgcccccagcactttctgtgtggctctgtctgtgcaaccccaggctctcctggctgcatgttcacctttgtgtccctccagcacccgtgcagtgagcatccagcacgaggcaggcaccaagagttccttcttgtccccaggttccaacctcactaatctagccctcagacgatccccatcccttcttagaactcaaagattatctccaaaactgtgagtgtccctgattatgtctagaataaatgtttccagaacaaattctccatgactagcctctgctgcaattctcaacctttgctcagtctcttactaagccccaccctctccactgcacaaaccacactgggctctgctgttccgcagcagcatcctgtacttccctgtctccacacccttgctcaggcttttctttctgtctggaatgccctttcctcttctccaactacagccactcatccctctggggaactttcctccaggtggccttcccccacccagtggaacagaaccgcctttcctgtttcctcctgatggggtctgtagcagcctgagagcagggccaagtcttcactgtgtctgtaacccaaaggcccactgcagatgccttacactatcaaatcaggttcccggggatagagtcttatagctttaatgaatttccttcatagcacttatactctgaaatggtatatacatttgctgactataagacagaaattctgagggcagagactccactccttattctattcaccactatacacccaggaattactactgagcacagtaggtgttcaatacatttggtttattcctccaaaaactaaaaatggaactatcatatcatccagcaatcccactttgggtatttgtccaaaagaactgaaatcaggactttgaagagatatctgcacacccatgttcactgcagcattattggcatcatttctttatccattcattcattgatggacgctttatggcaacagccaagatgtagaaataagaaaagcatccatcagtgaatgaacggatagagaaaatgtggtgtacacatccaatggaatactattcagccttaaaaaaaattctgcaatatgcaacaacatggatggcccttgaggaaaaaaacatgctaagtgaaataagcccatcacagaaggacaaacatacataattctacttgtataagatatgtaaaatagtcaaacacacaaaatcagagaggggaaccatgactgccagaggctgtggggagaaggaaatggggctttgctaatcaaccagcataaaatttcagttaggcaagatgaataagttctagagatttgcggaaccacactgtgcctatagccacattgtgcttgtaatggatacttaaaaatgcgtaaagagggtagatttcgttaagtgttcttatcacagtaaaatacagtaaaattggtttaatcaagtgaattcacttgaacaagaaatgtaactgatttttagcaatctggcaagtttagttgcttaaatagtggtatgcgtttctaaaaaagggttgttactaactaggggaagtgtaaatcatctcaaagtaaacatcaactatctgggatcgctcaggtattataaatacacttcgaaaagagtccctttagttaataataacagccacttcagggcaaggagtctctgcattgtttcctggctgagtttacttcgcaactagaaaagtctgcttctgaaaatgtcttctgaaaatgtcattgtggcagagagcaaaatgatagctataaatcaacaactgcagcaaatatttacttagctcttactacattcctgcactgccctgtgagctccatatcactacaatcttgtaatccttgcaacaatcccatgaagtaggtacttttattacccccattttacaggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtgagtgtactttattttctcctttttgatttgtggtttcctaagtgttctacaatgaatatatattatttttatatcaagaaaacaaatatgcatattgtaaaaattattggcccacttgcattattattgaggaggttgttctttttcttctacaatggtgcttctggtgaaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgcccccttttccccagctgaccagatgcagggcagtggcagggaggggctgataccaaacccggtctgggagactgcccggagggaacacaggttcccaagctccttttggagaggctggatgtgagttcacctcgaacctttcagctggtaatggccacctcttggagaatgtaactggttaccagaaaaccccagaggttgtctcccagtacctagcctaaagtgggtgtggccacagaacctaccaaaatttaaataaaagcaagaactaggcgtgtccagggatggcgttgtgctgtttatccgctctctgctcttcccactcctccttcctttgggattttgtccaagactctgtaaattaatttttctgtgcctgtttcctcataaaataaacaagctaacctcacagcctgtccctccttcctctgggggatatgtgacaataacagatgggtgagccacatgtccctgaaggcccctccagggcaagggcgggagagccccacatcacaggttcgtgccacgccacagacatgggaacagaggaaggttccacgccagtactcggcccactgaacgctgctgcttctgggcatgtgaccaagtgaaagggaaaattgggtttcgcatctcactttccatctcagattaaataccagatgaagaagcaggcccatttaaagaaggctgagccctggagaaagacagcaacatggtattatcagtcattttaggctctttgctggagagggaagttggtaaaaaaacctaccaagaaaatcctgtaagtcctggagcctggcttaacaatttcattctgctgggcctcagtttctatacctgtgagtcagatgatcaaaaaggattctttctagatcttaaattttagctatatagggtggttccaaacagtaagcttctttgaaataaaaagccagattcccaggaaaatcgatttagctcagcgtctgtatagtacagacacgaactagttacagtgccagcctaagatgacccttcagatggctacagtagacccttcagatggctacaggaatactgaatgaacaactctaaatgacacaattatcaaacagtaagtttcattttattacatcccttctactggattcatgtgctatatagcatttgggccaatttgaaggtccttgaatgtttctataggtgtaattagttgccccaaagtttaacttattgtcatccaattccaaacaactctatactgaaagaaactatctgaggaagggttgtggaatgtatgacttccaaggatgcttaagaagtcaccccatctaaccttctgatattattatatattaggatgaacagatccaggaatcccgtgtcacgcacatggaaattgtccattcctcatttttcaagtgggctttgtgtataagtcaggctagaaagtctcatacaatatgtctataaatcagacggagttggcgtggcaaacattacttgcactgaattttcttgaggcaaaatgccaacagactccacccaaatgtgatgaggtcaaacatttataagcaaggctttgaccgtgacaatgcatcttgtcattctgtggttcagaagggcaaaggtaatgtttcttcaggctacagttttctaaagagaaatgttaaaccaacgggatgacaactggggtcataaagggctagaaagcaacttctgacctgaagaccccacccctcgccctgccctgttcctcttttcaaacatcttggcattgcacaagtgtcctgcatgcctgtggacaacagctggcactgcagaccagctctagcaattaagttatcagctaaccagctcctcaagccaaactattactcagagacagttatttctgggcttatgtcacagatggaaagaaagacccagtcagtgggaaccatgggaatccacacggggctccttataaaaaaatgactcactgattttgctaaaagtagcccatgtagttaccaacagtatttcaaaacagtcaaatacctccagaaaaggaaatactttaaaaaggtatacatgaaaagatgctcaaccacactaaccatgaggaatgaaaattagaatcataatgagatggtgggcatgtaaacaggcatgccttctacagtggcatttttggcaccagctaacataataaaaagaccgccgctccttttgattccaaaattccacctctaggaatgcatcttagagttacatctgcacattttttggattagtctctatttcatttatttttttacattgataaagaaaaattgtatatatttatcatgtccaacatgttgttttgaaatatgtatacactgaggctgggtgcagtggctcatgcctgcaatcccaccactttgggaggctgaggcaggtgaatcacttgagcctaggagtttgagaccagcctgggcaacaaggtgaaaccccatctctacaaaaaatgcaaaacattagctgggcatggtggtgcatgcctacagtcccagctactcaggaggctgaggtggcaggatcacttgaacccaggaggtcaaggctgcagtgagctgtgatcgtgccactgcacttcagcctgggtgacggagcttcgagatcctgtctcaaaataaaataaaacataaaataaagtaaaattaaattaaaataaaacaaaattaaatatgcattcaatgtgaaatggctaaattgacagtgcaattagcatatgcattacttcacatacttgttttgttgtggtaagaacacttaaaatctactcagcaatttcttttttttttttttgagacggagtctagctctgtcacccaggctggaatgcagtggcgcaatctcagctcactgcaacctccacctcccaggttcaagtgattctcctgcctcagcctcctgagtagctgggattacaggcgcacgccaccacgcctggctaatttttgtatttttagtagagacagggtttcaccatgttggtcaggctggtctccaactcctgacctcgtgatccgcccacctcagcctcccaaagtgctgggattacaggtgtgagccgccgcgcccagccagcaatttctttttttttttaagctcctcccttttcagcaattttcaagatatatttgcacgttatcgtgccaactgtatacacttgcaccgtacatgctaaactgtgtaaatccactgtggcactgtttgtaacggcaaaagattaggaacagcctgaatgtcacccaccaaaaggatggcacctattaattctggtctatctatatgatggactgcgggaggcagctccgaagtacagacatggacaagctccaagatttactataagtgggaaaatcaagacacagggcagtggagcgaatcccgccagggctccacgtgagtgggcgggtgagctgggagaagccccagggtctgcaggcagggtctgctctgggagaggaactgggggatatgggtggtacagacattcttcactatctttttgtagccttttgtcccaagcacatacacacctacccaccgcagggtgcttcagaaaggtgaaacgctgcatacatggtctgatttgtgctttgcatctcgatttggattccaacaggaggcaattttgagaaagagactaagattacaggtgaatggaggtttcttgaggaaactgcatcagggcatgtgtgagaaatatccctagatacaagaaagaggattatggcaaaaagaattggaggagtgccagaagccgggcccctcagccacacccgggaacactgctcccgggtcattctcttcagcaggtttcccacctccagcccttgtctgcactctcgtggctttccatagctctacggtcaggcccaaatacttcacgcaccctcaccgcccctgctttggatctctggaagagcaaggcccttgtctgagtcccaggactcggccatcctctgccctcccctgggaaatgctgagcgcttggccgagagggccctctgagctgggtccgtctattctgggaccaccccagttctataaaatgaatcatgaccgcccctatcaccagttattaatcatgatccatgttaaatggtttacacatgttatcttcaaaacaaccctgggaaggaaaattccctcactttataaaagcggaaagaggctcacagggccccatgctgggattcaagctcaggtcagcctcctccagggcccacaggagtgtgcctgcatctccccacctccctctgtctttctaaggaaaatacagatgctccctgaaagccttgttattttcagcgtttccccaaccacaggcttgtttggatggtcgagatgcctgcctgcctgccgggcacaggtacatgaaacctgaattcaagccacacgtgtatcctggggaggaccttttgctgtttccctctcactctgagcttcatagataacaggaacggctgatatctatggagcacttaggtatgaacacagatcattcagattctcgtaagatcccactgtacgagagaaagtaccttcccctgttttagagcaggggaaaatgaagctcaaagaggtgaagtaactcgcccaggttgcccagctggcaagggaaagagccagggacagggagaaacgtgcccggccagtgtttctcggcatggattgccactgcctctcttccacctagaatcctgcatttataatctttccctcccaccttctaggctgggggttccccactggtgcacagtgattaggagggagagaagctttaccacctctagcaacagggattgaggctgtgtaacaggaatgtccccataaaaccagggaaggttattaaacgtttcaaagtgtacctgaaaacttaaaaaaattccttctttattttcattaggggttcctaaaaatcctagcttccgaagtaggctaggcgggggtgctcctgcaagcagtgagacacagacagaggacccagcatcaggcctcacgccctccctgtcagacgcccatgaggccgacagggtcacttggtgactcctgcgggacagtcacctctgcttccttccaaagccctgccctggaaggaggctggttagtcacagagcctgccccaccccatcgtctctctcactcaagttctcccctccgttctctgagagggcagccttcaccctcgggcatacagagatgcaggacaaagcccaggttggtttcggtaggttctccaagtttgccagccccttctttcacttgttttggggatggcagggtatgtaggagggacaggctcaggctcaggagtggtggctcagccctaacccagattcctcaaaatggggccccctgtatcagaaccctctggaccctgcccagatgcccctgaaccatgtgccaggaagtttttttttttttttttcaaataaataaatggagttttgctctgttacccaggctggagtacagtggcacaattatagctcactgcagcctcaaactactgggctcaaggttctcttgcctcggcctcccaaggagataggactacgagaacacaccaccacacccaactaatttattttattttttgtggagactgggtctctctatgctgcccaggctggtctggaactcctgccctcaagtgatcctctcgactcagcctcaagttctaggactacaagtgtgagcccctctgcctggctgaagcagcattttaacagctccccaggtgataactgtctgtggaccctggggctcaccgtgctagtcttccgagcatcatttgcagccgtgtggactccagagcaggagggggcagcagggaaaggctggcctagaacatatatgccacatgtatgacagagaaggaaaggacagcaattgcacggccgaaggaaagagaaaaaccagcaaccaaacacgcccagagaactgagtggcaggcccagggctgttcttgcccagtacaggaagacccggacattcctaataattctaggtaatcaacagaagattgaaaaagacaatccttcagtggcttcctggtactctcagagaaaaatctatgcacttccccagggcctacagctcacagcaggtggcgggggggcctcctgatctcatcacccaccacttcctggctgctccctagcctctgccttccccgaatctgccaggtctcacctactctctgcctttgccaatgcagctcctcctgctgaagagctcttcccccaactctctgccaggcaaaccctccattctttacgtccagcctaaatgccacctcctcagagagccctccctgactgcccaccccttgctgtgggacatgtctttgtttcaattgcatttgttttgtgttttggctcctctatctcccctagtatatgcttcatgaaggcagccatgaggtctcactgttgctgtgaaacctaaggcacctggcacctgacacatagtaggtgcttaagaaattgaccagggggcacagcagagtggggtgcacagcagacattcaacataagaaaacctctttcccctttccactatcctaggagtgagaatgcagggtagtgtgtactcttttccaagcaaaattatcatcaaaaattgctaaaggaaaaaaataggagatttgatgttgctgggggaaagcatcaattacattttctcatggggtttgctgccttctccgtgtgtgtgactggcagctgtattttgccctggtttgcatccacgcctcttgtggttaacagcacgcactctggaaccagactgcctggtttcaatcccactcaaccacttattggctattttggtcatcagccaccttaaaatgtagtggcttaaacaataacttctattttctctggaggttctgtgggttgactgggctcagttgggttctcgcttggggtctgtcagaaggtgatagtcagacagtggttggggctggagttacctgacagctcaactgagctggttctgtgatggcccctttactcacatctcagctggaccagccaaggaggctgcctgggcctcttggcctctccttgtgactagcttgggcttccctcacagaatggccgtctcagtcacagtatgacaactactaagagtagttggactttttagatggcattcggctttccacagaatgaacacttgtagagatttaggtggaacctgcagggcttcttatgacctagccttaggaaatcatgaagtatcacttttgcagaattctactgatcaaaagtgagtcagaaggtcaatccagactcatgaagagaagactcccaaggcacgaatgctgggaggcacaggtcttggcgtggtggtgggaggaggcagtatctttgaagacaagctaccatacttgctacatgattgtcagcaaatttcttaagctctctgtgcctcagtcttctcttctataaaatgggataattgctcctacctcacagagcttttgtgaggagcaaatgagttaataatatgtggaaagcacttaacaatgcactatgagagtattagctattattattattactcaaaagagtaaggagcaaatgtttttctctgattaatctctgtatcccaatgtctgagatatcccgtgaaatgttttatatcataaacataaatatgaaatgctctatatgcaaagtaagtgaagtgtccttctccccatcaaataaaattttttgtttttcatctaaaagtcaaggtttcaagtttagataaaaacagtcatttctcacaatcaataatgcatttgatgtattaacaaaaactcaaactagctgccggggctggcgaacgctgttgtgagtcacagtggcgatatgctcacatcagggccggaagcagtaacacttgtggtgtggaatttcccgtggcaccagcggaaaaggagtctggatgcgtttgtcaaaacttccccgaaacaaaaagaaatcaggatttcctgctagaggcccaagtggctagtgatgtccaggacctcacaacccaacctcagactggccttagccctggctggaaaacaggatctgccaacaaatcatcagggctgggccccagcctccagggatggacacttttctgtcactgccaaatccagacaaagctcagagtcaggtcactgaatgcaaactctaaataaaaaaatggcttcatgatccacgcctgtggctgcatgttctattctacagaattctccaccacgtcctcccatacctcctacccctcagtattccatgtggccttcaggacaaattcgagtctcctgccacatgcgcccacctgccatggacccatgttccagccacatgcacagcttccgttcctccaagggccctgagctcacatatctctctctgttctttcatacactctttctgttgtctagaagagatatcaacaggaagggcagccacagttctctctccctcgactcggtgctaggcagaggctgtggtaagagtgtcatgtcttcgtctcagtttgtctgcacgctggcctacagcgccctgccttggctggctagagagctcacccatctctccagccaggctctgatcaacagcctttcagaaggatagacacatagagcaatggaagggaactgagggttcttggtcttttaggaaaaaagactcatttcttttttgcatatgtgtgtgttttcctctcaaatccttcttgttaccaaagcctgagaggggaagtcattcttatctggacatctctaagtgttctctctcctttcccgagcaagcttcaaaatccggtcttttgtcttcaaagttcaaaagtggatgcatttgtacttccctgattgtggtctgctggtgcctttttcatttttttctgcacccctcttagtcacagcttggatgtccaggccccatttcctagctctgtcgattcttttgagatatgggttgagtaaaccttatccgaaaaggttgggactggaagtgttttggatttcagattttctgattggggaatatctgcacatacatatataatgagagatcttgggaaagggacccaagcctaaacactaaattcatttatgtttcatagacaccatacacagatggcctaaaggtaattttacagaacatttaaaataattttgtgcatgaaacaaagtttggatcgtgccccgtcacatgaggtcaggtgtagaattttccacttgtggcatcacgtcaaaaagttttggattttggaggattttggattttgaattttcagtttcaagatgttcaacctgtattgtgtttgagcaccttagctgtgttggcaggcccttgaaacagcctgttcctgtttatatcactacccaggcgcctttttgattcttgagggctttccttaacatctccttaacattgcctaggaggacttaaagatgtttgtatatagacgttaaaatggtaatcagtgattctgaagtttctgttattgcccgtcatgttacctgaagtgcagttagatcctcccggcttcatgtactattactgtccactgcttttaccagcagggcattttctgtccttttatttttcattgtcttcccagttctattcattggtttataatgaataggctgggattaagaggcgagagcttaaacatcaggaaaagacactctcgaattttcatttgacagctgttgttcctgagagaataagtcgatctgttagaaaatttagatagagctttttccttctagagttatttaaatttttaaaagggagaagctgtactatttttattaccaaaatcaagtctattgaaggctacgcaaaacctcatattctcaagaaaccataggaataatctgtggttaaaacagcaccttgaaaatgccaaatgctaaatagattgataagaataccagttgctacattataatttttcaaaggatgttatgattggagtcagaatccggaggtttgtactaagtagctgggaacacacttgtgttcatgctaactctagaaatatatcctagattatgtttaggttcagcatggactcaatagtattctaggaaacagtatttcagcggccagcatgataagaggtcgagtgggaaggaaaatgctatgcgtgtggataaaggtgctctttcttctcatcgcagagtcaaacacctggctgctatcaccaaggacaaaggatgttctgaagagtgaaccaactcagatttacccacacacttcaagaaagcaatttagaaaaccgcaggaatccaaacattctttcattggctactaaaatacaagaaaagaaatcaagaaaagtttgtaggacttttaggaagctattacttgatcagaatattattattataaatatatcagaacacttttatccttgcttgatgggaattcaacacttcacgtcagccaggaaagctacaggttagtaactaaactaacctagtctgttgtccctaaagattttctgccaatggccaggcatggtggctcacacctgtaatcccagcactttgggaggccgaggcgggtggatcacacctgaggtcaggagtttgagaccagtttggccaatatggttaccatactgattatcattttaacatttatatacaaacatctttaagtcttcctagacaatgttaaggaaatgttaaggaaagccctcaagaatcaatatggtgaaaccccgtcacttctaaaaatacaaaaattagccaggcatggtggcaggcacctgtagtcccagctactcaggaggctgaggcaggagaatcacttgatcctgcgaggcagaggctgcagtgagcactccattgcactccagctttggtgacacagcaagactccgtctcaaaaaaaaaaaaaaaaaaaaagattttctgctaaccataattgaactaaggaaaacttgaggggtaaggagtttccatacggagtagtatactaaaaattgctccaaaatcaattgccctcatgggtttcatttatacggctcctaaacaggagatttagatgacgtttactcccctggaatgctatgtatttttttttttaaataaatagggatgaggtctcactatgttggccaagctggtctctaactcctgaactcaagggatcctcgtgcctcggcctcccaaagggctgggattataggcgtgagccaccgcgcccagccactcagcttttgagggttaatcatcaaccgcacaaaggggaaaggaggagcagtggagggcagtacacaagcggccacctttcctccttcccaggcacaatgcccataagggaggcaaagacccgccaataaagtcagtgggggatgctttaaacatcttgtggggtcacagtttgtacccagtctattatcccatgttgacattaattcttggcaaaggtggggctgtggtcttatgaagctggtcttacgaagctgggtgtaggtgtgagtatacgtgagaacgtggcactgtttgcaatcgtttgagctgaagctgctttacaacagtatgcattctttggggttagtgtgttgaaaatgtcagctgagtgacttccaccaccagctgcgcccctaacaccgtgtggcaccgggcttgggaaccacagctgtggcccgtcgtgctgtcatcgcttgtggctctgggtccttccccacctgttgctgtgtccgtcggtgtggcagggaccgccgactggctggaacatatatgctatttctgtgcataggatgtgagtaagtacatgccatagtaagtcagaccaggatatgagtcagatcatattataaagtgatacaaagaactgatcttcaaagcattctggaagcattaatccacgtgtcaacactattgtaagggagctacagtttgaaagacacgattactaagcaaaggagagacgctgcaagactcaggtgaacagaactggctaaaggcctaccaatgaaaacaaatgcatatggtgggagccaaaatccggaggccttaaaatttagaggtaaaaagaaagagttagcaggaccacatatttctccagcatattcagtcagaaatggagaagcagtgaaacacgggcagctcagaatagctgtggaacatgggcctgctttattatccatactatctgcagagcaacctttctggggctaaattaatggtcctcaactgactcttaaaaaaaaaaattgattggcactgaggtgtaaagacacacataaaaagacgaccatccacagcactatttgtaagcataaaaactgattaaccatcatgatgtccacaaatcagcaaaatgaactatattatgtcactttcatggaacccaagtagctattaaaaggaatgaaataatctgaatatactggcatggaatgatgtccaaggtagactgttatgaagaaaaatcaaggtgtagaaaatgtgcatggtaatcccatttctattagaaatgtgtttgcatatgcgcaggaaaaagtctctaagaagtgagagaaaaccattaataattgttaaatgtgacagtgagttttttttaaattcttattcattgactgaatcctttgccataaacatctatacttttataatagaaaataaagccaacaagatatttatgaatagcattaacctgttttttggtgtttttttttttgtttttttttcataattgcaaggttcttggaggcccgggaaaggtgaccttaatggcattccatagctggcaagtccctgactgaaacagtgaaggcacagcaggcaccctgggaggcctcggctcagcatagccccgagctctctgcgggaccacggagcagcagagatggcattcccaaaatgccaagagaaaggagggcttattggcctcggaatccctttcttgacccctgtcacgggaccctcactggcctatgtaactgcacttctgctttgtgagctgtggggtgttcactgccttgtcataacctgcgaccgtgaccccacacaggcttctgctcaaccctggcatgcccagacttctcagcacggtgctaccgacttgctgttcaaggggttgtgaagagttctcagccagaagtgatggcagcgatgcatctgctccatctcctccctcccagcaacccgcctttgtttcaagggccagggcaaggaaaagacttgagctgcctctggacctgtgatggcaggaacccatcctgaccctcccgatcaggcatttcctctccgtaagtcaactctgtcctctggtctgcccctgatgcccccttcctccaggacggagggagatagcaggcccaccggttttttgtttttttttttttttttgagacggagtttcgctcttttgcccacaggctagagtgccatggcatgatctcagctctccgcaacctccgcctcccaggttcagctctcgtgcctcagccttccgagtagctgggactataggtgcccaccaccatgcccagctaatttttgtatttttagtagagatggggtttcaccatgttggccaggctcttctcgaactcctgacctcagctgatccacctgcctcggcctcctaaagtgctgggattacaggcgtgagccactctacccagcagacccatctgttttgactacaaagcacaggcctagaagcagctattgcctcagccttgtcttgtgaaggctggagaaacttatgcttcggcacaagcattttctatccttcacagatcccctctgaatgcttcataatctctccctaccccacagcttcccttaggtaattcctactccttcagatcctagttccaatgctgcttcctccaggagcctctcccaacacccccgaggccaagccaggtcccctcacacctcgatacctcccattgtttaccccactcctcatcttcatttactcatgtgtaacttgacaaatgtctttctcacagaatataagcctctggagggggcagagtctttgatgctatgaactcctggttgacacttggggccccttcagctgcccaacagctgtcctggaggacggatagaataatatagggacagaaatcctctgctcacagcagagagggcctcagccagcacttggtggggaggggcagggacaggcactgacctcggctgatgcgctgcttctccccagaaaggatgccggggctgtcgatgacgctgatgctcttcaggacctgattggggagctgtgagcacatgaatctggaagagacggatcaaaggaggggtcagaaactgggcatcacagagtgctccaaccatggggcttcttggcctctctgggcttactgacatctgtaaagtgggggcctgaaggagactgacagaaactgaggatgcctaatgaagttgtttgtgaagtaggagcttggaggagattgatagcacctccatccagccacagagaacagatgctggcccatgggacaggtatgagaggtgcacaagcacctgctgccatctgccacctgatgcctttctgttcattttgattttagctaacatttattgaacatgcaggtatcttacaaatatcctctcatttgatcctcatattgacctcatgaggtgaaggaattatgcttaacataagagaggttaagtaatgctcagggtcactcagagcggtgccttaaaccaaggtcagcctgcctccaaagccatgggcctcacctctcctggctccatgctggcccctgcccaagcatcctgggcctctccccctgggaatcccatgccttcttcaggatgcactggcccactgggctggagagccccaagctccctgcctatttcctagcatgaaagctgaagggactggggcctgtttccccatctgatgccccaggaacttagcatccagcccagtgtcccctatggctttagggccagggaggggcaggcacctgtgacacccaacatcctccaggtgcttaggagtctaggggagctggagagtaggtgaggggaccaggttggggaaggccctggctgagcatctttaggcccctcttgttcctcatttgcctgataccatctcctcctcctgatcctggtccctttccctgtagtcactgcccttgtatccactccacggaagcagagtgcggaggaaaaatctagcctgtgggtcagcagacctgggttcaagttctgcccagcgtttcctgataatctgctatgggactctgggtaagggcctccctgctctgggtcttgggttcctcacatgaaaatggtggcttcccgacagggtctggcgatgtccttttagctttcagactgagtaactccaaaagtgatggcaggaagtgctttgttacttccaccctgggcaccagggtctgggatggacctttgtgaggcactgtgcatgtttaaggcagaaagtgtagaatgcctctccttttcctttactatggatggctgacatctgtgtctgtgtgggcagaaagctaaaagctcaattcttccgtacgatggaagtggtggggattactcacaaagtaaaaatgctgggaatgcaggacagggaggcctggccagcctccacagtgcacatgtggacaccacagccctgggtatgagcggccgttactgacatttcaaaatcactttctctgaaggggcttgggatacgatttttcacacagtctttcctacattttcaaatcggcccaggaagatatagaaaaagacattaggatccttttgcaggtggaaaagttgaagcacaaagcagttatgacattctgaggccatgctgctaatgcacggctggttgcagactgcaacctactgtttctgatgtcagtggggtggaatttaacccacaaagttaaaaacctcataacattaaaagtaaagggtcaagttagtggaagagaagcccccaatttccacctgtctgcagacacttgtgcacagtcccctcctgtaccccaacctttaaataaaccctactacccaacacggggagaggtttgtgggaataaagcacatgaggctcaccaagcattctttgtaagttcacagaaaaaaccccaccatgccattattcaattctctagaattggggtgggaacagggctctgggcacatccgtggtgaacctcgtttcttgtcaggaatgattgtctctcagtgccgtcccattctttccatcagatggcccgagacatctggcggagctgaacatatcacacctacgtgaaacaattttctgcaaaccattcccgtggacaggctgatcttttccccaaaccacaagctcacactcaatatccatttttccaaaacagccaccccctagattctcaggtgaggctaacagagggattcaaaatttgcacactgttcactccctgtgtataaagtgacagcctttccacagctcccaggcctcctgacatgacagcagaggccaggcacgggagccacagagcaagccaccgtgagatgtgctgacgtcaccacatggcatacaagcgggcaaagcgaggagcccaggatggctgaaaaagagaggatgaggagcagcaggtggaggcggagggagagctttggctggggcacctcaagagtgggcagctggggttttgggtgcacagctggactctgctccctgaaagacagtgtccaggggtgaggggcaggcaagagaacagaaaggagcattgagaccctgtggtgccacgctcatgctgcgaggtgacaactgcatatgaatgcattcgtacgaagttatgctgggatcagaaaaaatcctaatggtgttctagcaatcatgcctcatgcttcttctctgagaaagggaggcgcacggcaaacgtacttgctgtgtgtataacagcagtgcagtggtagtcgtagcccagtagtgaagaacctgggctctgcagtcagcactgccaagttcatgtcccgaccccatcaactcacagccgtgggactgggcaaggtatgtcgtgtgactcctctgcgcccagtctcctcctttataagcagaggttcacagccctacctgtaaggttgtggtgagcctggagttaatgtgcacggaaagtgctttgaacggtgcctgacacccagtaagggggccctggccggcccagcttattgaaatgcttccaagcacagatttgctgtcccaagatggatttcctactccttcctggggagattaacacaaggaggatctgtgccttgccctctacatttcacgtaaaatatgcagacacatgctggttcaacccaggagcctcacatggccctcacccgaggatgacctgataaatgttgtcttctgaagtaagagaagaagacggagcaactgaagatcctaggctgccccctcaactccatatcctctccacgtctaaggaagggccaggggtagcagagatgggggataaagtaatggtccaggctatgaggtctcaggcaagctgctaggagtcctgccacacagtaaaaggagagagcaaagccaggcaccatgactctccctgtaatcccagcactttggaggctgagtggggacgatctcttgaacccaggagttcaagaccagcctgggcaccataatgagacttcgtctctacaaaaaataaaattagccgggcatggtggcatgcgcttgtagtcccagctactcaggagcctgaggtgggaggatggcttgagcccaggaggtcggagctgcagtgagctttgatggtgccagtgcactacagcctgtgcaacagagtgagaccctgtctcagataaatacatacatacatacatatctacagaaggagggggcaaggagattacttaaaatttcccccaaacactaaaattccaattaaatgatcagcattttaaaaactagacttttagaagaaccagacagtaccttaatactgattttgatttctcaacaaaacagtaatatctgtagcagttataataataataaaatagcacaaacatttcctcacctcttactgggtgtcaggcacagtttgaagtactttccatgcacattaactccagccttactgcagccttacaggtagggctgtgagcctctgcatttagaggaggagactgggcacagagcagacacatgccataacatgctgagaagtgatggagctgggacatgaacttggcagtgctgactgcagagcccaggttcttcactcctgggctactatcaccatggcacacactggaaccactgctgtgtggcatatcatgtgcagggcaacatcctaaaacaaaggggtgacgtgccacagccctggaacttgcccctaagaggcttccttgtgtggtttgctctctacctagtggtgtggagtgtctgtcagggtggggaacaggaggtaggagatttaggctccagacgtctcccttactcattctgagaccttgaccttgcacaggtctctaaacctctctgagcaattctaccaggcctgcggacttccaggtttgccattaggttcaaataaacctaagcttacagcggagagagtatagaattgtttcaaagtacttcttttcaccccagcccactttattgatgagggtaaaaccagagagataatacaacttcctaaatttgcacagtaaatagaacacaacccacaaaaaagactttgacaactgaactgtaataattcttattatatggtcctaccacaaatggctaatcttatcttccagtgcctaggaagaactaggaactgaatttcacatccagattacagcaaagcccctggttgccctattagattgaaactaattaccacttttaaaggttaaagattatttaagactgccaatttcatatggttcaacctaaatatgtacttttataaatcccctcctgactgccacaggggaaagcccagtgcaatggcccagccaggaaggtctgcctgaccccagggagaaaggcatttctggaatgtcaggaccagaaatgtacaggcagctgctagtcaagaacaatggtttaggccaggcgcggtggctcacgcctgtaatcccagcactttgggaggccaaggcaggtggatcacgaggtcaggagttcaaatcagcctggccaacacagtgaaaccctgtctgtactaaaaatacaaaaattagccgggtgtggtggtgagcacctgtaatcacagctactcgggaggctgaggcagagaattgcttgaacccgggaggcagagtttgcagtgagccaagattgcgccactgcactccagcataggtgatggagcaagactccgcctccaaaaaaaaaaccacgatggtttagtgaccagggaactaccacccagggaaccaccacaaatcttttttattattgttatttttttagggacaaggtctctcgctatgttgcccaggttggtctcaaactcctgagctcaagtgatcggcctgcctcggcctcccaaagtgctgggattataggtgtgagccaccgtggctggccaacaaatcttgaggttaaagaataatggggaaagcttcagcaagtttattatagataaatgaaccacaatacacatgcacaagacaacccagttattccctcagattaaaaaaaaattattttgctggtgaatcaagagtcattcttggcaaaagcctgttttccttaatttctgcagctaaattggctgggggaagccgcacgtgcttggactgatgctgtgaactttagtaagtcagtttttaaaaattcccagtggtacacagtgactatcaaatattcaaaacttggctaggcacagtgtctcatgcctgtaatcccagcactctgggaggccaaggcgggtagactgcttgggcccaggagttcaagaccagcctggccaatatggcaaaaccctgtctttacaaaaaatacaaaaattagctgggcatggtgacacacgcctgtcgtcccagcaatcgggaagctgaggtgggaggattgctggagcagaagttgaggctgcagtgagctgtgatcgtgcctccgcgctccagcctgggcaacagagtgagactatatatatatatatatatatatatatatatatatacacacatacacacacacatacatatacataaatttggccaggcatggtggctcatgcctgtaatcccagcactttgggaggccgaggcaggtggatcacctgaggtcaggaattcaagaccagcctcgccaacatggtgaaacctcatctctactaaaaatacaaaaagtagctgggcatggaggtgggcacctgtaatcccagctactcgggaggctgagagaggagaatcacttcaacccgggaggcagaggttgcagtgagccgagattgcgcagctgcactccagcctgggtgacagagcaagactccatctcaaaaaaataataataataaaataaaatcaaaactcaaaagctaaactgagtgaagcctcgcttaattacaaatacagaagtaacaaatggagtagaaggtcaataatacacctgcgtattttatgatgggggaatcaccattcaagcataacacagtggttgtttatcatcaccatcatcaggcccagctaaaatgactgagccctggaagggctgttcacattccttcagctcaaagggaagtttcaaaatttcaattcccagggccagtgattcaagttattttttagaaagaaacagaggcaatgaggaagtacatgagattaagaatttcttctgtggaagataacaatttaaaataatactagatcctagacaaaaaatgtctacagctatctgaatttgaaaatatacacattaccattttttagaaaaggagactgaggaataacataacatcttattcaaaagcagactgcaaggggaaatgtcagaccccaatgcctggcacttccctggcgtctcagaggatccaatgctctgggtgcccttggctgtctcctcctctgtgaggggcaactgcctcctgatagcaacctctggaatgtcaacaagcacctccccagagctgctcccagatgggccactgaggaattcgtcgtgagcacagcagtctgctagagtttcagaatgtctcactaaagccatttccatagacctctgtgtgttctaaactccttttattgttcaagtatggaatttctctaatataaacctttttaggaatttatcttcatttctcagaaatgcaccatagaccccttgtcgctccttagaagccagcctgggaggctgtgactcgggctttgctggtttgcttaatggtggagggtgttgtccccctccaggtatcacctggtacttaactcttttaaagatgcccctgggggcagatgcccaagccagcactccttaaggagaaggccaggtaataacgatctgtcacagggagattctggtgtggctgcttgggagagaaagttctccgcagaaaacaagcaattttctttactaggtgttacattttgacctagttcccagagaagtatgctatgtgaaaagaggtttgcctctagtactaaccctgtgctgttcccagacggaagctataattatgtacacatatttgaacgccctaactaattgactctttcttaaataactgctgtgtgatgcagtggcactgtcctgtggatactacttaatgaggctgtttactcttaagtagctatgagtttacatgaggcatgtcccttacacgtgagcctgacacacacttggctagaaggacagaaactcctcttggccgatgctgagcagaggcatagggtgtgggacaggggagaaggggaacactggattccaatcccctctctgcctcttcctgatggcctctccctgagcaagtcatgtctttgctttcggccttctcatttgtagattggcaacagtattgtctgtgttatcaacgccaaaagaataatgtacatgaaattacgtaagtgatgacttgggacataatcaccgtcatcttcatcatcattactggagggctacattaggaacagccttactaaccctaaccctaaccctaaccctaaccctaagagttaaatagggggcactgggcagtgattcccagtccaaacatcatactattggtcagctggcctgggttccagtcccagcactgatctcactggtggagtgacccccagaaattaaagtaacctctttatgccttgattcctccccctccattgaggataacagtagcatcatgtcacaggggttctgtgaggatttaaagctaatacacaagtctagaacagaatctgacacataaatgccatataattatttgctattatttttctatatgttattctgaattcaactgacacttgcttttattataaggcatggattattttcagcaagttttaaattctgagacaagagctttgccattcaaaatcgttcctaaaaatttcttttctgtactcatctgtcatgtgcttgggatttgagaagaaaaaaacattttttttttttgttaggaaagtaaatcatttgccaaaataaagcaagccaataaccactcttcctggtttctcccttgtgaattcagacttcacaaagtgggaatttgaaaaaactggcagcttatttcgttaagcctttgttgggcaaaaagagccccagacaaagggcagtggcaatgaaaccagaggaccccagggaagccttccacagagacagatcctgtgccttgaactttctggggcctcctgttctggtctacttcccctccaccctgggccactctgtcctgagagatctggagagttgaccctctggggttctcccgcccagggcttaaccccctctcccacaatgagacactctggtgccaaccaagtcagctctggagttgaagagtaaactcctcctagaaaagtcagccctgcaggttggaaaaaaatcacctggacagtgttcctatcaccatcagtaataagatggaactcctctgggactccttccacatcacctgcaggtttctgttcatcccactgccaagttccctggttgctttctttgatttgcaataggatcatcaaaaagcccctaatggagaattcagctccccggagagttccatcttccacagaaggcacctgcggaggggcctgggtggccctcagccgagccagtgcacagcatccagcacatcattcattccccaggccacatgaatggtgcccctggagctgcgcgatgaggcgcttcggcctttgggaggacagcagccggctgggaggatccgttcctatttttaaaaacttctagaaaggagatgtggactgtcagctctaatgctacttcctctccctaaagaggctcggatgaccctccctagctctgtgcctcctacaacccactcctccaaatcagccacacgaaagctagacccaggaaagagggaaatagaggggtgggagagggatgataggaaacaagaaaaaagcattacacaaacgcaaggggtagcaaataggaggtgcaggagggaggaaggaaggcagatccagtgggaaagggcagagttgtagccaggggtaccagctggcctgtcttccccaggccagcagccctcagttccactgggaactctaatgaaaggttatgggaggagtacaaataaaacacatctccaagtgaggcagaacctcagtgaccccacaactttacatctataaaatagtgaccacgtaggctgggtgtggtggctcacatctgtaatcccagcactctgggaaggcgaggcgggtggatcacctgaggtcaggagtttgagaccagcttggccaacatggtgaaaccctgtctgtactaaaaatacgaaaattagctgggtgtggtggtgggtgcctgtaatcccagctacttgggaggctgaggcaggagaattgcttgaacctgggaggcggaggttgcagtgagcggagatcatgccactgcactccagcctgggagacagaatgagactctatcttcccccccgcaaaaaaaaaaaaaaaaaaaaaaacgaccacgtaagaaaatcagcttttcatgtttttcactctgtttccctggccctgctctgatgaataaggaaacagctcaaagctgggagtgagaagcaaaagggacagccagggaggtgaggggtcctgttctggagtcagtgggtaaaatccgagtgtccggtgaaggttaggggtcctctgggctaagctctctgactgcagaagcccagcgcaccatgcctgagaggtgtctgtctaaccagtgcttaacattgccagtgacgaggagctcactgcctcatgaggcagcctaatccatttctgtgcagctcaaattattagaaatttgttccttatactgtaagcatttttattttttaacttttaaaattttttgcagagacagggtcttacttcgttgtccaagctggtctcaaactcctggcttcgaacaatccttttgcctcagcctcccaaagtgctggattacaagcacgagccacacacctggccctgtgcagccttataatgtccagttctgggccttagctctgccctctcaagttacccagaataggcataaatgattatttcctatgatagtctttcaaatatcttaatatgataaacatattttgtatgacttctagagcagagattctttgttcttctgtttttgaacctttatatgtaactggcagtaattcaaagaaaaggtttaaacagcctgaccgaagatggcagcttgctggtccttaccgattcaggaaagcgtttccaaagcgactgagctttctaaacggctttttggggtccacgactaaagcattccctggggtgctgccctcagtctctccatacatcacggcgatgaaggagtctgtggtgggctccggaccaatcctcatgcctgggaaatcctgctccagtaggtatctgggagagggaagaagaagagaaagcttagcatcttatcacaaagtaagaggccagaaagctgcctgggattaccaatttttttacataatcatttaaaaacgtagaaacataacccccaagaaaagcacgcaatcctcctctgcatttctgttgatgcaacagacgctaccccaagggaagtgtaccgtgctggctcctgggcatcctggaagctctgctcaggctcagctcccttaggggagcctccctgacctgcatgtggggacacctcttttgtggtccctgggcaccctgtgcctgctgccagcgtggtgctcagcatgtgtactacaattacttgtttatgggccctgcaaggtgtctgagctgatgagggcagactcatgtcccaaccatgccaggaggatgatcttcgtcttataagccttgaaggggctcaagggaaaaaacctgcacagccttctgcagctccccattcctgcaactaacaatctatttggtcctaaactacttctttgtttctaaaaagttttgactgattctaatgtaagcccacaatctgtgactatttccagggaaagagagaaagtgctgaattctatcaaatgccaaatacaatttttccatctttaaaagaatgagaaattaagccaccatttagacctatgttttctatgtaaataaaactgaaaaaaaatttttttttttgagactgggtcttgctctgttgcccaggctggctggagtgcagtggtgcaatctcggctcactgctgcctcgacctcctgggctccaacaatcctcctgcctcagcctcccaagtagctgggactacagacacatgccaccatgcctagctaattttttgtagaaacagggtttcaccatgttgcccaggctggtcttgaatgcctgggctcaagctatcccctcaccttggcctcccaaagtactgggattacaggcatgagccaccgcaactggcctaaaactgaaattgtttagcaaccttaacgggctatattctaaacctttaattgatgtcattgctagttttcacttcatccaaagtttctacgtttctgtgaagttgtggcaccccagaatagatacaccattaaaatatgtctcctaaatttacagtaaatctgatgatatcttttatctctaaatttagagaaaaaaatctgctaatagcacacggcatttactgagtgcttgctatattcctgatatggcgctgagccttctatattgtttcacctcatgctctgaggtggatgatgacattaccctcgttttatttacaggtgggaaaactggggcatcagagaggccaagcggcttgcccaaggtcacacagcggatgttcgagtggaaatggaatgcaagcattcagactccagaacttgcactgtcttcagaaatggcctcaagttagtggtttgctcaggggtgaagagcaaagcaaagttcagggcctcatcccagggtgtgtcacttggcatgagggacgaggacccccatttcctctcagctgaggggaagagctctccacaatgtccccctgcacggtcctctggctaccctgacaacaagggccagctctccctactctccctggagtaaagctgggctcaggaggtgctaccgtttcaaaatgtgttcagctttaatttttaaaatatcttcaagagtttctccatcaaaacctctgtatccctaatagcctagaaatgttcgtgttgatcaattcttacacattccacacaaatctgagaaatgctggtaaaagttactgtgagggatgcccactctgtgaaactccagcctctatggagtggatgcagagcgtgtggactccatatacccatgggaatgtggaatttaggttttacagcccctctgggatctcaagggtgaagacattcagcagcgaggctggaattcaaagccagatcacactcttgcctccactcacgtccagtttgatttttacgccctgtggcctggatggggctatgtctggaggctggtatgactgagggaggagagactgctggggagggaggggcttgggagaacagcagccagtgtcgcccagctccccgcagcacacacagttcgcaattcacgaaaatgtgaggtgcgggagtgggtttgaagcttgacaggcactttgctccagaatcagtgctaatagcaacggtgggctggccaagacggcctacaaaaggtcacacacactgattaaagggatgaaccagacgagaactgcagcgtgtgctttttggggaagagctcggtgtggagctccaccttgggtggctcgcggcaacacggccccttctcggcaccttcaccaagcctggccaggaggaggcccttcagattccgggccagggaggtgagcatacggatatcgtagttaagcagtgagtcccccagctggacaatcactcacacagcacaggtgttgaagtcagacatcactgtcgaggagtgcctgaattactttctgatgtttcattcctgtacaagtacagcaaatcccactacttttgaaataacaggggtttcaaggaaaaatataaatgaaaaaattgtttaaagaagagcagatgtttcctacattcaagtttatattgcaatcgaagccagagttttctaagtagcgaccctactggacagacctttaacaataaatcatttttaaagtgtgcttcaagtgtgaaataatttgaagtcaaaggtgtccccctttgactgtgaccttggtaaatcaatctctggatctcagacacagaggaagaactagaattaggaagaattactgtattataaagcttgcttgcattatcaatttgtttggtgatactttcacagataatacaaagttaacattcagtgttcaatttcaccatcaaagaaataccagtaaagacagagcacattaacaaatttttgaaaactcggaatcatcaatgctggcaagggtcctgtgagataaacacccttatatatgttggtgggggaataagttggtctaacttcactaaaaagcaatttgacaccatgtgttagaagcctttaaaatgggggtcttgctgggagcggtggctcgtgcctgtaattccagcattttgggaggccgcagtgggaggatcgcttggcctaggagttcgagactagcctgggcaacatggagaaaccccgtctctacaaaacatacaaaaattagccaggtgtggtggcgtgcatctgtagtcccagctacttaagaggctggggtgggatggtcgcttgagcccagggaggttgaagctgcagtgagctgtgaccatgtcactgcactccagcctaggtgacagagtgagaccctgtctctaaataaataaagaaaaaataaactcaaatggggattttgcggagttgacctctaacagctcgtgctggtgttatttgagggcctgtttcctctcctctcttgggctgtcatttcctgcagggcatggtctatatactcagtactttagaaacctggagtctggtaggaatgatttgagtcagcctcttatctttacaagcgacaagactgagggttagtgcaggaacatggcttgttgctggtcaaactcacagggtggccatgcaggatccagaacctgcagcccctttctcctggccccagacttctgctcttacaccaggcacagcaccatcaccctggggtcctacactgcccccagctccctggtgctctaagcaggacctggcagatccctgactttacatatgacactctaagctgattgccctgaagaagatttttcactgggggactgcagaaactcagattcatctgttacactgctgggtaaacaggtacatgtcagtgcagtgagggaactcggaacaaccaagacaccaagtatctgacatggaaaaagggagaatgaagtgatggatccacacacagcaagctggaagggaagagtctgagctgatgctgaggtgcaatgtgcataaatgggtcaatcacacagccacacgggatagacagcctgatcaactgtgttagacatttctcacggtgggagtgcctcagaggctttcccaaagctacgagtttcagggactctagtattatctgcaataacaacaattcaaaggaacaagaggacacaggaagaccaccgtgattcagagctgattagcccctccacaggcatcctgtgctttggagacttgatttttgtccttggctccactttgctccccctttcctgtgttctcggagaggcctgccaattccagcaatgattgctccaaggttctcgagccaagccagccacataaaaaggtatggacatttggattccaagcagctgggcggaagggatggtgggatggatgggagacctgacatccccttgtcctggtccgatgaggtccccagttcagactcatccaagtggctctggggtaccccggttgccagcattcagcccaagctcacagagctactttgatgcaagagtatatatggatggtgtcttctttttttcattgcttaggctagaattttttttttcacttcatagaagtgaatgtcatttatgacaaggggaagaaaaaaaactctcaagatattgaaaacagagatactctcaatatgtccaagcaccatcttctcaacgatgagcttaagaatgaataaaaaccaaacaaatctaagtggcacattattcaaacaaatgctggagtagtgggcaaagcattacactttaaataaatatacctaacgcttgaggactcgttatgtgctaaagtctttacatgaatagtctcatttcatcctaactaccttatgggcaggtactatttctatccctattttacagatgaggaaactaaggctcaaatgggttaagcggtttattaagatgaaggatttcttactagtcttatgaggacaccacccaccctaaatcagagcctgagaggccgacgggttccactgggaatgtttacaggaacgtgtcctgtgaatcataacaaatacacaaatgtaagattttaaaaataatacggcacatatattttgagtgttgtatgagcattatttttaaattatcaagccaaatctaaagaaatggtttgtgtgggctgggcgtggtggctcacgcctgtaatcccagcactttgggaggccgaggtgggcggatcacgaggtcaggagatcgagaccatcctggctaacacggtgaaaccccgtctctactaaaaatacaaaaataaaattagccaggcatggtggcgggcgcctgtagtcccagctactcgggaggctgaggcaggagaatggcgtgaacccgggaggctgagcttgcagtgagccgagatcgtgccactgcactccagcctgggtgacagagcaagactttgtctcaaaaaaaaaaaaaaaaaaaaaaaaaaaagaaatggtttgtgtgatgataaacgagatcttaaaatatgttcgtgcataccttggcatctgtgcatggagtttgggggttcaattcattgctattgcctgaaacatttttaaaataagttttggaaagtttcatgtaatatatttttcttcagaatacttacttgatccactatttcactaggagagggatgaaaaggaagagttactacttctactctgatttgatttgagcctggaaagatgttttaagagcagtttctggccgggcacggtggctcacacctgtaatcccagcactttgagaggctgaggtggatggatcatgtgaggtcaggagttcaaggccaccctgtggcaaacacggtgaaaccccgtctctactaaaagcacaaaaattagccgggcgtggtggtgcgcacctgtaatcccagctactcgggaggatgaggcaggagaattgcttgaacctgggaggcggaggttgcagtgagccaaaattgcaccactgcattccagactgggtgagactccacctcaaaaaaaaaaaaaaaaaagcagtttctattgtttaatctatccttgtgtttcacaccaggaaaagtaagtgggagaatcaagcatttattacttccaaagtcttacaagataggccaagatatataaatatttcctagcaaaacagtatgacctgcactatcactgcttctagatactaacaaatgacaggttactctgaagccgtactgtacagtttataatgcatttcacacattcagcttatttcatcctcactgccatgggagcaggtatttttattcctagtttatagaggagaaaactgcttatgccaagttaaatagcttacaggagaccacattaatactgggtaatgactacttttaacattttgatgtatttccatcccatcatttttcagtaaatgtaattttcctttataaaattgagataaaagttaaacaattttgcatcttgatttttcaccattagtctttcctcataccattaaaaattctttgaaaacatgatttttaatggctgcatactattctaagttgaatatgtatcaatttattttgtcatttcctgttaggcatttaaatagctttctattttttgctgttataaataatgctgagataaacatccctgaacaaacatctcatctacttaaaaaagtctcctttgaattactgaaaaactaagttaggctgatcttcacttacatttttttttttttttttttttgagatggagtcttgctttgtcacccaggctggagtgcagtggcatgatctcagctcactgcaacctctgcctcctgggttcaagtgattctcctgcctcagcctcccaagtagctgggattacaggcgtccgccacacactgggctaatttttgtatttttagtagagacggggttttaccatgttgtccaggctggtctcaaactcctgacctcaggtgatctgcccgcctcagccttccaaaatgctgggattagaggtgtgagccaccgcgccagcctcacttacattttaaatgtgaaaactaagttttattttcatttttcctttagttaaatcattgacatgttatcaccaggactgtttgttcagatgatgtcacctttgaaactgctgtgcctactaagggaatggacattaggtcattgaaccaataaactggaatttgctgggtaaaacttttcgtatctcaggctatttttccagctatggatgggatttatactcctcagggctgagatgtgcttgaaagcacactgctgtctacccactgccattacctgtaagttgctccactccaccttccatgctgttttgggaggagggtgaaagaaagggaggggaatttcactagaatcaaatcagtttcttacagttctatttgttcttccagtctttcagtcatgcaatgactatttattgagtgtttttgatgttgtaacttgtaatttaggagtatgacaacagactttaggttgtaaactctttgatctgggagtactgtaaatcgtcatgaggaggttatggaacacagcatatcccaaagttacttgactatggaacccttttattttctttgaacacttacgaatgatctcccacaactgcattccacagaacataggttaaaggaaaaggctaaaaggcatctaacaaactccatatccattttgtttttttctccaaatagaatcatttaaatgaaatccttttaaaactagtaatagataatttcttaatgcaattaatttatagataagaagccaccagctgacataatctcttaaggtgaaataacataggcaataccattaagattagaagcttgatatgaatgcctacttcctggtattatgaaatatggaacagaaggggagacaaagtaatcatgaaggtaactgatacagttatctatctagaaaacctaagagaatctactgacaagctgtcagaataacttcttgagtcaaatgaccagatataaaacaaaaatgtacaactcagtagcttccttacatatcagcaataccctgccaaaaaaaataagagaaataaaaagcccattcataagagcaacagggcataaaatacctaatacattaataagagctccataggacctgtatgagtaaatcaatcacttttccaagaaggtctgcgttaaagcaatggtgagctgctgcttgggaagagcaaatacaaaaatgtaacttagagacagaatgcagttccaggacaaatggatcccagtgggatttttttttgtttgttttgaagaacctaactaagaaagttcttctcaaagaatgacagaaaatgagaattgatagcatttgaaaaataaagagtaatgcacgcagaagagtcttgagctaaaattattaaaaagtatttcaaagtgacaatatttaagatggtatggtgttggcataagaatttacaaacagaataacacgagacaaaggtcctaacagactcaatatagtatttaataacttagcgtatgaggaagcctcatgtgacagcagaaaaaggtagatttaataatagtgttagaaaatgacaaaagacaaaaaaaaaaaaacccacaacaatataattgagacagattttacttccaggtgggttaaaaagttaaatatttaaaaagtaatcctattttaaaaagagcgcccggccagccgccccgtccgggagggaggcggggggcagcccccacccggccgccgccccgtctgggaggtggggggcgcctctgcccagccaccctgtctgggaagtgaggagcccctctgcccggccgccaccctgtctgggaggtgtacccaacagctcattgagaacgggccatgatgaggatggcggttttgtcgaatagaaaagggggaaatgtggggaaaagaaagagagatcagattgttactgtgtctgtgtagaaagaagtagacataggagactgcattttgttctgtactaagaaaaattcttctgccttgggatgctgttaatctatgactttacccccaaccccgtgctctctgaaacatgtgctgtgtccactcagggttaaatggattaagggcagtgcaagatgtgctttgttaaacagatgcctgaaggcagcatactccttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccccctcggagaaacacccaagaatgatcaataaatactaaaaaaaaaaaaaaaaaagaggcagggcacggtggctcacgcctgtaatcccagccctttgggaggccgagacaggcagatcacttgaggtcaggtgttcgagaccagcctggttaacatggcaaaaccttgtctctactaaaaaatacaaaaattagccaggcatggtggcccatgcctgtaatcccagctacttgggaggttgaggcacaagaaccgcttgaactggaaggtggaggttgcagtgagccgagaacgtgctactgcactccagtgtgggtggacagagtgagagtctgtttcaaaaaaaaaaaaaaaaagaatatgagtgaacatttcctgagtcttaagataaacaaggattttctaaccaaaaaataaaagatattataaaaaaggaaaaattgttagatttgatcacaaatattaaatatatctgcatggaaaaactattacaaaaattacaaggcaaatttcaaactggaaaaacacttttacaactgtgacaaaggattgatatctgttactgagaaaaacatttacatttatttataagaacaagaccagggccaggctcggtggctcatgcctataatcccagcattttgggaggccgaggcaggtggatcatgaagtcaggagatcgagaccatcctggctaatacagtgaaaccccgtctcttctaaaaatgcaaaaaattagccgggagtggtggtgggcgcctgtagtcccagctactccagaggctgaggcaggagaatggcgtgaacctgggaggcagagcttgcagtgagctgagatcgcgccactgcactccagcctgggtgacagagtgagactccatctcaaaaaaaaaaaaaaaaaaaaaaaaaggacaagaccaacacttcaaatgaaaattggacaaagttcacagacaattcagacaattcacaaagtaatatggaagacaactatattttataagttcaacgtcactagtaagaaataaacaaattaaaataagtctgttctggctgagtgccccatggctcacgcctataatcccagcactttggactttgggaggccaaggcgtgaggatcgcttgagctcaggagtttgagaccagcctagacagcacagcgagatcccaactctacaaaaaatgaataaattggctgggtgtggtggtgcaatgtacctgtagtcccagctactccagaggctgaggtgggaggattgcttgagcccaggagtttgaggctgcagtgagctatgatggcatcactgtactccagcctgggcaacagagcaagaccctatctaaaacacttttttttcctatcaaattaattttaattagttttactggcagtttggtgaattactgatcctcatatttctggtgggagtctaatttggaataactgtcctaaaaaagaaagatagatacatagatttaggaatatatataagcctgaaaaaaaaaaaaaatatatatatatattttgagacaaggcctcactcagttgcccagactggagttcagtggtgcaatctcagcttactgcagcctcgaccacctgggctcaagtgatcctcccacctcagcctcccaggtaactgggactacaggcatgcaccaccatgtccggctaatttttgtatttttttttagagatggggctcaccatgttgcccaggctgatcttgaactcctggagtcaagtgatttgtccaccttggcctcccaaagtgctgggattacaggtgtgagctgctgcgcccagcctattatctatattttttgaggcactaatttatgcttaggctattctaagaaaaaaactagaaatacaaagatttatggccaaaaatgttcagttcattgcaacattatgtataacagcataaaaacagaaacaacctaaatgtccaacctgtactatagattatgatgtagtcattgaagttatttttgaagactatataatgacataagaaaatgctcatcgtatcatattaagcaaaaaagaaccccatttattaaattatatttacacaatcctcagttttgtaagcatgaattctatgtcttcatctaagtcactgagagaaatgtgaacagatggggtttggaacggatggaaggttcagcaaagtcagcctcccttttctgggttgaggctagccctcttccattcctccattaactgaaccttcatctggcaatggttcccaaatgtttcctaggggagggcacataagaattactgtgagagatggtttagaaaaacaaaaacagattttggagcctgacccacagagatttcgactcaggaggtctgaggtggggccctggaatccgtgtcaaaaggcctccaagtgattctgatgcacagccacgtgcagaaggaaccacggccttctggttcgaggttttgaaaaggacattgaacaccttttgtaagtcagcttctgaatgtgagttagggaagataatgtcaggatggaaaaagccttccccctcctacatttctccaaatactctgttgctgcttgtcaggtggatgatgtgacaactggcccagctgctggcctgcagcgcttccctgctcggactgcagctgccagcgctcccctgcccaccccccgccccacctactcacctcctgcctacccccaccaccccacccagccccgcctaccctgcagctccttgccctgctcttcaggacttttgctccaagtcttgcctcctctttgtcttctgagatgccagctgctccctctccatggcttcccttctgtccacttttcattctgctgaggttgtgcttgtctttacccaaacccctgtgatgcttgtggccaggcctccttcccccaggcctagctgctgagaatttgacgcctcacatcccactcattcctcaacccgcgccatctggcttccttcaccaccactcacaggcacacctcttggcaaggtcacctggctcccaaaggctaatctactggttctgtttcagtccttttcctggaagcatctgacactactgaccaccacctctctccctggcttttgtgggggtcatcgttgctttacttgcctcgtatccccttttcttggtagcagcatcctcaggagctgccttccccagctctcaggccacgtggttggtggggctgacctccccactccccacatttcatgcccctgcccctaaggattggttcagggatgggcatatggtcagggtcaaaccaatgagactcaagcctgagacttttactggggctgctgagccagcagaattcgaggctggaaatggaggtggccgcctgcccacccctgagaaggaacacaacatgaggagggccacagagccaacagagtcctggtgtgtctcctgcagtcctgggccaagcctgaagcttgcacatcctggtctgatgggtttcaggaaaacgttcttatctttttatctaagctagctttggttggatttctgtcacttgcaacctaaagagatctgagacagcactgagccactaccctcccaggcaattacccacctctttggtactttccccggagggtctccacaagctctgcttcctctcacttaagagtcctgtgcaaggacttctacttcccagatgctggctactaaatgctgacactcccaagtcaacagaccagcccagatatctccctgagctccagacccatgtcttacccctcatggacatcgccaccttggtgtccactcaaacatgacaggtctaaatctaaacttatcattatgccccatccttcctcttcttggatccccatctcagtgaacagctgtactccccagttaccccagaaaccgaggcctcatgggtgacacctccccaccctcactccctggccctctttgggcagctaattctctgctcattcctcagggctcagcttttaggctgcattctcagggaggcagccttttccaacccgcaagcctgaatgagggggtccctcctatgcccccagccaccctgtgtttctagtgttacagcccttgtcactcagagctgtggcctgttgactctcttctgtgatggctggccccaaccctgaaatcaagatcatttgaataaatgaacactagcatctgtaggtgtgatcttatattgtatattgaaaatatagtctaattttctgtaaaaattaaatatctcaatattttagagagatctgtaaagggtataatatttggaacagaagattgattttcaggagccccagtatctggatgagtgtgagaaccactaaataggacccatagtttttctgtgtgagattttatttttttaaaaatagatgaaccaggctgcctattagtgaatgccttcacttcccttttccttaattactgagtctagaaacttatcaagggaatgaagcaggcctttgttcctattcagaatccatttccctgcttttttgaaaatgagaacatctgcctgcttccagtgttccaatacttttcatattcttcacaatttcttaaaagccaccaaatacagttctttgagcagaaatgcaagttctttcatccatgtgtccggccagagatttcctgaacctcgcctgtggcaggccctgggagagctcctcagcctgtggttttaatcccctcttgaacacagctgggctcccttctgccatctctggggcattttctttgaggaaaaggaggaagctgagtagttctgctttctgttaatattgcagcaagagcccatgagtgggccgatcacttcctgattcttgttcttgttctaatcataccttaaaaggcttttttaatgtccaaggcacttttaccttctcagcccactccagcttcttgatccttcataccgcccataaaccttgtctgcacccttgcacatgcacccctgccccttttttcccctattaaatactatagttaaatgttaatatctaaagtttttaaacacaattacggtatcaagcattttattaaaaatttttatcatactttgattttaccaacttgagtgttatgaacaatgaacatgtttatacattgacaagaatactcatacagggattgtgggatggctactttcactcccttttccctcatctttactcctttttttttttttttttgtagagatggggtctcactatgttgcccagggtggtcttgaactcctgagctcaaacgatccacctacctcagtctcccaaagtgttaggattacaggtgtgagccactgcacctggcccctcatctttactctttagttcctttgcccttgggttcttctagcttatttctactttgttttctttctggcatccatttctattttaaattattacacatagatgcagaaattacttggctggcgctagttgcagaatcatgaaaattaaatcacatgatgcttagtgttgaaagactgaattgttttggttttttattgagatataattcatataccagaaaatttattcttttacagggtgcactcctttagtatattcacaaagttgtgcaaccaatatcattatccaatttcagaacattttcatcacatcaaagagaaactccacgcccactaacagtcattctctatttcgtttgcatgcggctatccagttgtcctagcaccatttgttgaactatagtttcccccattgttctaatagtttttaagtggtttcttaggattctctacatagaagatcatgtcatctgcaaagagttttacttttttctctccagtctgggagtttatttcttttcttgccttatttccctgctctctacccttttaaagcctatatagtttcttgagtgacttccctcttttttcctcattagaataagttttctggggagagggaacagagcatatgaagggagaaagtggagctcttaaaaatgtgtagtttgggatggggcgcggtggctcacgcctgtaatcccagcactttgggaggccaaggcgggcaaatcacctgaggtcgggagtttgagaccagcctgaccaacatggaaaaaccccatctctactaaaaatacaaaattagccaggcgtggtggcacatgcctgtaatcccagctactcgggaggctgagacagaagaattgcttgaacccgggagggggaggttgcggtgagccgagatcatgccatggcactccagcctgggcaacaacagcgaaactgtctcaaaaaaaaaaaattgtgtagtttgcattcatttcaaatggacttcatactttttcagtggaaatgtcttccttcacagcacctggggccagggattttctggaggaatctttgaaatctgttttcctcaagttttggacacaagcctgggtgagctccatatccatccttcctcggctagtacagagtctaagatgacatggtcactttcccccatgcccatctcccctccttctctggccaattctttattgccagtcaaaggcagaagagccaacagcaataagagaagattcccaccatgtcagcacaggttctgtgtcatcagtgacctcttggaatgtgcaggaagccagggagataagaatctatggctatgtagattaggtacaccccacagccaagtatgagcttctagggcccaatcgctagaagcaaacaacccagaccactaaccaggctctaactaaggcaggatccaggatgctcagcaccctgggccaacccttccgctcaagatgaatccatggttcatttacagtgtctggggtgatatttaattccaagttcacaagtctccagggtagctgcccttttgtttggggatttcctcccgggtgctaaatcacttcctcctagctccaatctgaaaagcaattcaggtctcctgtggcctcaccaagcttcctgcccacactgattttcttctaacctcactggtctaccttgtgtacatcacctaacaacaaagccacttagctcaaggaaagcctcaagaacaaatggcttcctaataaggtgattcctccctcaccctagggtggcccacagctccagcacctgctgagaggtggccaatttggatgaggtagctgccaggaatcaaatctcagaacccttcataaaactgcgcttagctattccacaaatttctccaaataatgaaacagagagaagagtgagaatataatgagagagaaatctggaaaaatacaaaagataaattcatgttcctgtgagttgtattcatcttcctgggagttgataatcaggctggctagctatccagtctatgggagcagagagagggctgcattatctccaggttggcacagcatctagcaggggctccctgatgacacctgggcacaacaaggacctcacagcaaagacaaacaggaggaaatgcctagggtgtggggacatgccaccactaaattacaaaaatatatgcctttcttctttgtatgtttcaacagtaccgcttcccactcttgtaccacttggccataacactttattatccctagtacctaaaaactagacagtattactgagaccttaaatgtgacatttgtcatctttcaaggtgccagttactgtaatacagctatggttcattttgagtgtctgggtgacggtgacatatttaattctatttttgtcttgtccataagcaccaaataaagcaattttgaaattactttcttcacactcaatttattatctagaacgacatttcaatacacagtatatttgttttgtggaattcattcgcagtgtatctggaggcctggatttaacatatttcctgtagtgatagctactctatttgtaggaactatttaggtcactggagtggagaaaaagaggtcgctacttaacagaaatggcatgtatccaaatatagatgcagttttctcaacacctgttgcacatcaaatgatgaagagattgttacaatttccaaaaccctggaccaaaaccttaaatgatcagcactttgtttcaactgatacacggcttaagtcagaaaaataagttcttcttaccaaaaacagtgagcctaaatatgctggctgctttagaaataaaacaggtgatcaacaaagcaatctgtttctgtctaaataatttcccagcaaaagtcacttcttttgaaactatatgatttgaaccacagggtatgcacagtgattgtgtgctttcagaaacacggtaagcatgacaaatattttcagttgtcaagggtaagcgaggagggaatgacccacctaagaaatggaaactaacaaatagtaatatgacactcccccttagttccacaggctggtgcggctgctacacgcagctcacttcctacgggcggctaaaggcggtgcatgaactgaacgtaggcggcctctttatcccctccccacaacactgtggggtggcacgtaaagacctcaagggaagggggcctgggcgatacgctctcctgctgccattcatttgttcaagaaatagttgaacaaatgaatagttaaacaaactctccaactaggactctgtcccattcggataccctacgcctctccccccatttccatccctaggcatcactccctcgtcaagaatatgctgattatggctcgcgccccctctctcccttggaccctcccgccagggcgaccggacgaggccagcgggagcaacgccttccgaaccgcaaggaaggagggctcggagtgcgcagggcgcgggttcgcgggaccctccagcgcgcggggctggccagccggggcggggccgagggcaccgggcgccgagctccgggaggggtccccgaggtcgcgccggccgggaggggcagcggcgggaggcggccgactgcggcgcacacgtggggagggcggagcggggcgggagccgggcgaggggcggtgacggtacctgatgaaggtggtcttgccggtgctgtactggcccaccagcaggatcatgggcttgttctcgaagtcggcgtcctccagcgcaggcgagtggaactcgtggaagcggtacgcctcctccagcggcagcaccttgcgcaggtagagcgagcgcagcccgcccgtcaccgtctgcaccgcgtccgcgccgccagcgcgttcgcgcccgcccgcctgccgccccatccagctgaacatcctgccgccagtccacgctcggatgggaccctgctccgggttcgactctccccggctcgcact
